United States Patent 11,446,398 (REGULATED BIOCIRCUIT SYSTEMS) - sequence listing, part 8

SEQ ID NO: 30024 - protein, 1262 aa, Homo sapiens
  Payload ID: 5876
  Gene Symbol: FAM21C
  Gene Name: family with sequence similarity 21, member C
  ENSP ID: ENSP00000352922
MNRTTPDQELVPASEPVWERPWSVEEIRRSSQSWSLAADAGRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 30025 - protein, 1320 aa, Homo sapiens
  Payload ID: 5876
  Gene Symbol: FAM21C
  Gene Name: family with sequence similarity 21, member C
  Uniprot ID: Q9Y4E1
  ENSP ID: ENSP00000363482
MMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 30026 - protein, 279 aa, Homo sapiens
  Payload ID: 5876
  Gene Symbol: FAM21C
  Gene Name: family with sequence similarity 21, member C
  ENSP ID: ENSP00000416630
MMNRTTPDQELVPASEPVWERPWSVEEIRRSSQSWSLAADAGRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSD

SEQ ID NO: 30027 - protein, 1279 aa, Homo sapiens
  Payload ID: 5876
  Gene Symbol: FAM21C
  Gene Name: family with sequence similarity 21, member C
  Uniprot ID: Q9Y4E1
  ENSP ID: ENSP00000439811
MMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 30028 - protein, 1245 aa, Homo sapiens
  Payload ID: 5876
  Gene Symbol: FAM21C
  Gene Name: family with sequence similarity 21, member C
  Uniprot ID: Q9Y4E1
  ENSP ID: ENSP00000442128
MMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTNEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 30029 - protein, 1341 aa, Homo sapiens
  Payload ID: 5876
  Gene Symbol: FAM21C
  Gene Name: family with sequence similarity 21, member C
  ENSP ID: ENSP00000485513
MMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 30030 - protein, 272 aa, Homo sapiens
  Payload ID: 5877
  Gene Symbol: FAM210A
  Gene Name: family with sequence similarity 210, member A
  Uniprot ID: Q96ND0
  ENSP ID: ENSP00000323635
MQWNVPRTVSRLARRTCLEPHNAGLFGHCQNVKGPLLLYNAESKVVLVQGPQKQWLHLSAAQCVAKERRPLDAHPPQPGVLRHKQGKQHVSFRRVFSSSATAQGTPEKKEEPDPLQDKSISLYQRFKKTFRQYGKVLIPVHLITSGVWFGTFYYAALKGVNVVPFLELIGLPDSVVSILKNSQSGNALTAYALFKIATPARYTVTLGGTSVTVKYLRSHGYMSTPPPVKEYLQDRMEETKELITEKMEETKDRLTEKLQETKEKVSFKKKVE

SEQ ID NO: 30031 - protein, 272 aa, Homo sapiens; identical to SEQ ID NO: 30030
  Payload ID: 5877
  Gene Symbol: FAM210A
  Gene Name: family with sequence similarity 210, member A
  Uniprot ID: Q96ND0
  ENSP ID: ENSP00000386115

SEQ ID NO: 30032 - protein, 268 aa, Homo sapiens
  Payload ID: 5877
  Gene Symbol: FAM210A
  Gene Name: family with sequence similarity 210, member A
  ENSP ID: ENSP00000465396
MQWNVPRTVSRLARRTCLEPHNAGLFGHCQNVKGPLLLYNAESKVVLVQGPQKQWLHLSAAQCVAKERRPLDAHPPQPGVLRHKQGKQHVSFRRVFSSSATAQGTPEKKEEPDPLQDKSISLYQRFKKTFRQYGKVLIPVHLITSGVWFGTFYYAALKGVNVVPFLELIGLPDSVVSILKNSQSGNALTAYALFKIATPARYTVTLGGTSVTVKYLRSHGYMSTPPPVKEYLQDRMEETKELITEKMEETKDRLTEKLQETKEKVSFK

SEQ ID NO: 30033 - protein, 67 aa, Homo sapiens
  Payload ID: 5877
  Gene Symbol: FAM210A
  Gene Name: family with sequence similarity 210, member A
  ENSP ID: ENSP00000467381
GLPDSVVSILKNSQSGNALTAYALFKAGVQWRDLGSPQPLPPGFKQFSCFSLPSSWDYRLQHLLGIP

SEQ ID NO: 30034 - protein, 178 aa, Homo sapiens
  Payload ID: 5877
  Gene Symbol: FAM210A
  Gene Name: family with sequence similarity 210, member A
  ENSP ID: ENSP00000468361
MQWNVPRTVSRLARRTCLEPHNAGLFGHCQNVKGPLLLYNAESKVVLVQGPQKQWLHLSAAQCVAKERRPLDAHPPQPGVLRHKQGKQHVSFRRVFSSSATAQGTPEKKEEPDPLQDKSISLYQRFKKTFRQYGKVLIPVHLITSGVWFGTFYYAALKGVNVVPFLELIGLPDSVVSI

SEQ ID NO: 30035 - protein, 192 aa, Homo sapiens
  Payload ID: 5878
  Gene Symbol: FAM210B
  Gene Name: family with sequence similarity 210, member B
  Uniprot ID: Q96KR6
  ENSP ID: ENSP00000360437
MAGLLALLGPAGRVGARVRPRATWLLGATAPCAPPPLALALLPPRLDARLLRTARGDCRGHQDPSQATGTTGSSVSCTEEKKQSKSQQLKKIFQEYGTVGVSLHIGISLISLGIFYMVVSSGVDMPAILLKLGFKESLVQSKMAAGTSTFVVAYAIHKLFAPVRISITLVSVPLIVRYFRKVGFFKPPAAKP

SEQ ID NO: 30036 - protein, 52 aa, Homo sapiens
  Payload ID: 5878
  Gene Symbol: FAM210B
  Gene Name: family with sequence similarity 210, member B
  ENSP ID: ENSP00000389768
  MOD_RES (1)..(1): Any amino acid
XPLALALLPPRLDARLLRTARGDCRGHQSDRWHTGLGDPLQSGTFCTHRAAS

SEQ ID NO: 30037 - protein, 287 aa, Homo sapiens
  Payload ID: 5879
  Gene Symbol: FAM212A
  Gene Name: family with sequence similarity 212, member A
  Uniprot ID: Q96EL1
  ENSP ID: ENSP00000329735
MDMHSARLDSFLSQLRWELLCGRDTGSPSMPGPLQPTSQTGPDVQPSHQLRASGALEEDSVCCVEEEEEEEEEAVVTEDRDAALGGPREHALDWDSGFSEVSGSTWREEELPVSQRPAPSAQPLRRQCLSVSGLPMPSRAPVASVPPVHHPRPKSTPDACLEHWQGLEAEDWTAALLNRGRSRQPLVLGDNCFADLVHNWMELPETGSEGGDGGGHRARARPPQFLLGLSEQLRRRLARARRTAMAGKRLSCPPRPEPELPADVSRFAALMSCRSRQPIICNDVSYL

SEQ ID NO: 30038 - protein, 297 aa, Homo sapiens
  Payload ID: 5880
  Gene Symbol: FAM212B
  Gene Name: family with sequence similarity 212, member B
  Uniprot ID: Q9NTI7
  ENSP ID: ENSP00000349805
MTMESREMDCYLRRLKQELMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDLPELEKGGEKGETGGAREPKGEKGQPQELGRRFALTANIFKKFLRSVRPDRDRLLKEKPGWVTPMVPESRTGRSQKVKKRSLSKGSGHFPFPGTGEHRRGENPPTSCPKALEHSPSGFDINTAVWV

SEQ ID NO: 30039 - protein, 282 aa, Homo sapiens
  Payload ID: 5880
  Gene Symbol: FAM212B
  Gene Name: family with sequence similarity 212, member B
  Uniprot ID: Q9NTI7
  ENSP ID: ENSP00000408238
MRQLMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDLPELEKGGEKGETGGAREPKGEKGQPQELGRRFALTANIFKKFLRSVRPDRDRLLKEKPGWVTPMVPESRTGRSQKVKKRSLSKGSGHFPFPGTGEHRRGENPPTSCPKALEHSPSGFDINTAVWV

SEQ ID NO: 30040 - protein, 114 aa, Homo sapiens
  Payload ID: 5880
  Gene Symbol: FAM212B
  Gene Name: family with sequence similarity 212, member B
  ENSP ID: ENSP00000436075
MTMESREMDCYLRRLKQELMSMKEVGDGLQDQMNCMMGALQELKLLQVQTALEQLEISGGGPVPGSPEGPRTQCEHPCWEGGRGPARPTVCSPSSQPSLEQPEPTSGAFPIRCS

SEQ ID NO: 30041 - protein, 181 aa, Homo sapiens
  Payload ID: 5880
  Gene Symbol: FAM212B
  Gene Name: family with sequence similarity 212, member B
  ENSP ID: ENSP00000437205
MTMESREMDCYLRRLKQELAPCFLSPLQMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDL

SEQ ID NO: 30042 - protein, 229 aa, Homo sapiens
  Payload ID: 5881
  Gene Symbol: FAM213A
  Gene Name: family with sequence similarity 213, member A
  Uniprot ID: Q9BRX8
  ENSP ID: ENSP00000361254
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 30043 - protein, 218 aa, Homo sapiens
  Payload ID: 5881
  Gene Symbol: FAM213A
  Gene Name: family with sequence similarity 213, member A
  Uniprot ID: Q9BRX8
  ENSP ID: ENSP00000361259
MGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 30044 - protein, 229 aa, Homo sapiens; identical to SEQ ID NO: 30042
  Payload ID: 5881
  Gene Symbol: FAM213A
  Gene Name: family with sequence similarity 213, member A
  Uniprot ID: Q9BRX8
  ENSP ID: ENSP00000361261

SEQ ID NO: 30045 - protein, 229 aa, Homo sapiens; identical to SEQ ID NO: 30042
  Payload ID: 5881
  Gene Symbol: FAM213A
  Gene Name: family with sequence similarity 213, member A
  Uniprot ID: Q9BRX8
  ENSP ID: ENSP00000361262

SEQ ID NO: 30046 - protein, 229 aa, Homo sapiens; identical to SEQ ID NO: 30042
  Payload ID: 5881
  Gene Symbol: FAM213A
  Gene Name: family with sequence similarity 213, member A
  Uniprot ID: Q9BRX8
  ENSP ID: ENSP00000478152

SEQ ID NO: 30047 - protein, 229 aa, Homo sapiens; identical to SEQ ID NO: 30042
  Payload ID: 5881
  Gene Symbol: FAM213A
  Gene Name: family with sequence similarity 213, member A
  Uniprot ID: Q9BRX8
  ENSP ID: ENSP00000482445

SEQ ID NO: 30048 - protein, 231 aa, Homo sapiens
  Payload ID: 5882
  Gene Symbol: FAM213B
  Gene Name: family with sequence similarity 213, member B
  ENSP ID: ENSP00000367681
MSRERGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRLWTQASPEFGQATWCLRRYNSLSILPAALGKPVRDVAAKAKAVGIQGNLSGDLLQSGGLLVVSKEVPRRLRPQGAHPAGPGHLCGGLCQRPASV

SEQ ID NO: 30049 - protein, 192 aa, Homo sapiens
  Payload ID: 5882
  Gene Symbol: FAM213B
  Gene Name: family with sequence similarity 213, member B
  ENSP ID: ENSP00000367682
MSRERGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKKSPGDYVPKEHILQVLGISAEVCASDPPQCDREV

SEQ ID NO: 30050 - protein, 213 aa, Homo sapiens
  Payload ID: 5882
  Gene Symbol: FAM213B
  Gene Name: family with sequence similarity 213, member B
  ENSP ID: ENSP00000367684
  MOD_RES (1)..(1): Any amino acid
XSRERGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKEVPRRLRPQGAHPAGPGHLCGGLCQRPASV

SEQ ID NO: 30051 - protein, 228 aa, Homo sapiens
  Payload ID: 5882
  Gene Symbol: FAM213B
  Gene Name: family with sequence similarity 213, member B
  Uniprot ID: Q8TBF2
  ENSP ID: ENSP00000394405
MSRERGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKGGDKVLLHFVQKSPGDYVPKEHILQVLGISAEVCASDPPQCDREV

SEQ ID NO: 30052 - protein, 246 aa, Homo sapiens
  Payload ID: 5882
  Gene Symbol: FAM213B
  Gene Name: family with sequence similarity 213, member B
  ENSP ID: ENSP00000413218
MSRERGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRLWTQASPEFGQATWCLRRYNSLSILPAALGKPVRDVAAKAKAVGIQGNLSGDLLQSGGLLVVSKGGDKVLLHFVQKSPGDYVPKEHILQVLGISAEVCASDPPQCDREV

SEQ ID NO: 30053 - protein, 191 aa, Homo sapiens
  Payload ID: 5882
  Gene Symbol: FAM213B
  Gene Name: family with sequence similarity 213, member B
  Uniprot ID: Q8TBF2
  ENSP ID: ENSP00000443605
MSRERGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKSPGDYVPKEHILQVLGISAEVCASDPPQCDREV

SEQ ID NO: 30054 - protein, 196 aa, Homo sapiens
  Payload ID: 5882
  Gene Symbol: FAM213B
  Gene Name: family with sequence similarity 213, member B
  ENSP ID: ENSP00000462185
  MOD_RES (1)..(1): Any amino acid
XAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAVPTPDRPRLLASRGTCLGTCCRAEGCWWSAKVVIKCSCISSRSPQATTS

SEQ ID NO: 30055 - protein, 154 aa, Homo sapiens
  Payload ID: 5882
  Gene Symbol: FAM213B
  Gene Name: family with sequence similarity 213, member B
  ENSP ID: ENSP00000463127
AAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKVVIKCSCISSRSPQATTSPRSTS

SEQ ID NO: 30056 - protein, 246 aa, Homo sapiens; identical to SEQ ID NO: 30052
  Payload ID: 5882
  Gene Symbol: FAM213B
  Gene Name: family with sequence similarity 213, member B
  ENSP ID: ENSP00000477600

SEQ ID NO: 30057 - protein, 192 aa, Homo sapiens; identical to SEQ ID NO: 30049
  Payload ID: 5882
  Gene Symbol: FAM213B
  Gene Name: family with sequence similarity 213, member B
  ENSP ID: ENSP00000479869

SEQ ID NO: 30058 - protein, 213 aa, Homo sapiens; identical to SEQ ID NO: 30050
  Payload ID: 5882
  Gene Symbol: FAM213B
  Gene Name: family with sequence similarity 213, member B
  ENSP ID: ENSP00000485906
  MOD_RES (1)..(1): Any amino acid

SEQ ID NO: 30059 - protein, 231 aa, Homo sapiens; identical to SEQ ID NO: 30048
  Payload ID: 5882
  Gene Symbol: FAM213B
  Gene Name: family with sequence similarity 213, member B
  ENSP ID: ENSP00000485959

SEQ ID NO: 30060 - protein, 228 aa, Homo sapiens; identical to SEQ ID NO: 30051
  Payload ID: 5882
  Gene Symbol: FAM213B
  Gene Name: family with sequence similarity 213, member B
  Uniprot ID: Q8TBF2
  ENSP ID: ENSP00000485968

SEQ ID NO: 30061 - protein, 196 aa, Homo sapiens; identical to SEQ ID NO: 30054
  Payload ID: 5882
  Gene Symbol: FAM213B
  Gene Name: family with sequence similarity 213, member B
  ENSP ID: ENSP00000487007
  MOD_RES (1)..(1): Any amino acid

SEQ ID NO: 30062 - protein, 191 aa, Homo sapiens; identical to SEQ ID NO: 30053
  Payload ID: 5882
  Gene Symbol: FAM213B
  Gene Name: family with sequence similarity 213, member B
  Uniprot ID: Q8TBF2
  ENSP ID: ENSP00000487468

SEQ ID NO: 30063 - protein, 154 aa, Homo sapiens; identical to SEQ ID NO: 30055
  Payload ID: 5882
  Gene Symbol: FAM213B
  Gene Name: family with sequence similarity 213, member B
  ENSP ID: ENSP00000487590

SEQ ID NO: 30064 - protein, 1076 aa, Homo sapiens
  Payload ID: 5883
  Gene Symbol: FAM214A
  Gene Name: family with sequence similarity 214, member A
  Uniprot ID: Q32MH5
  ENSP ID: ENSP00000261844
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLVPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVITLESLGKRGYRVPPSGTIQVTLFNPNKTVVKMFVVIYDLRDMPANHQTFLRQRTFSVPVKQEVKRSVNKENIRHTEERLLRYLIHLRFQSSKSGKIYLHRDVRLLFSRKSMEVDSGAAYELKSYTESPTNPQFSPRC

SEQ ID NO: 30065 - protein, 938 aa, Homo sapiens
  Payload ID: 5883
  Gene Symbol: FAM214A
  Gene Name: family with sequence similarity 214, member A
  ENSP ID: ENSP00000382153
MVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLVPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVITLESLGKRGYRVPPSGTIQVTLFNPNKTVVKMFVVIYDLRDMPANHQTFLRQRTFSVPVKQEVKRSVNKENIRHTEERLLRYLIHLR

SEQ ID NO: 30066 - protein, 1083 aa, Homo sapiens
  Payload ID: 5883
  Gene Symbol: FAM214A
  Gene Name: family with sequence similarity 214, member A
  Uniprot ID: Q32MH5
  ENSP ID: ENSP00000443598
MVFSGNKGLHREDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLVPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVITLESLGKRGYRVPPSGTIQVTLFNPNKTVVKMFVVIYDLRDMPANHQTFLRQRTFSVPVKQEVKRSVNKENIRHTEERLLRYLIHLRFQSSKSGKIYLHRDVRLLFSRKSMEVDSGAAYELKSYTESPTNPQFSPRC

SEQ ID NO: 30067 - protein, 963 aa, Homo sapiens
  Payload ID: 5883
  Gene Symbol: FAM214A
  Gene Name: family with sequence similarity 214, member A
  Uniprot ID: Q32MH5
  ENSP ID: ENSP00000444447
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLVPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVITLESLGKRGYRVPPSGTIQVVCVL

SEQ ID NO: 30068 - protein, 45 aa, Homo sapiens
  Payload ID: 5883
  Gene Symbol: FAM214A
  Gene Name: family with sequence similarity 214, member A
  ENSP ID: ENSP00000455002
RAFHPQTGLPLLSSPVPQRKTQSGCFDLDSSLLHLKSFSSRRNLS

SEQ ID NO: 30069 - protein, 126 aa, Homo sapiens
  Payload ID: 5883
  Gene Symbol: FAM214A
  Gene Name: family with sequence similarity 214, member A
  ENSP ID: ENSP00000455578
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLER

SEQ ID NO: 30070 - protein, 89 aa, Homo sapiens
  Payload ID: 5883
  Gene Symbol: FAM214A
  Gene Name: family with sequence similarity 214, member A
  ENSP ID: ENSP00000456725
MKPDRDTLDEYFEYDAEEFLVSLALLITEGRTPECSVKGRTESFHCPPAQSCYPVTTKHECSDKLAQCRQARRTRSEVTLLWKNNLPIM

SEQ ID NO: 30071 - protein, 95 aa, Homo sapiens
  Payload ID: 5883
  Gene Symbol: FAM214A
  Gene Name: family with sequence similarity 214, member A
  ENSP ID: ENSP00000457120
MKPDRDTLDEYFEYDAEEFLVSLALLITEGRTPECSVKGRTESFHCPPAQSCYPVTTKHECSDKLAQCRQARRTRSEVTLLWKNNLPIMVEMMLL

SEQ ID NO: 30072 - protein, 118 aa, Homo sapiens
  Payload ID: 5883
  Gene Symbol: FAM214A
  Gene Name: family with sequence similarity 214, member A
  ENSP ID: ENSP00000457402
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIK

SEQ ID NO: 30073 - protein, 142 aa, Homo sapiens
  Payload ID: 5883
  Gene Symbol: FAM214A
  Gene Name: family with sequence similarity 214, member A
  ENSP ID: ENSP00000457666
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIE

SEQ ID NO: 30074 - protein, 222 aa, Homo sapiens
  Payload ID: 5883
  Gene Symbol: FAM214A
  Gene Name: family with sequence similarity 214, member A
  ENSP ID: ENSP00000458036
  MOD_RES (1)..(1): Any amino acid
XPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMTLFNPNKTVVKMFVVIYDLRDMPANHQTFLRQRTFSVPVKQEVKRSVNKENIRHTEERLLRYLIHLRFQSSKSGKIYLHRDVRLLFSRKSMEVDSGAAYELKSYTE

SEQ ID NO: 30075 - protein, 30 aa, Homo sapiens
  Payload ID: 5883
  Gene Symbol: FAM214A
  Gene Name: family with sequence similarity 214, member A
  ENSP ID: ENSP00000479280
MKPDRETRSHSVAQPGLKLMSSSNLPVSAS

SEQ ID NO: 30076 - protein, 1076 aa, Homo sapiens; identical to SEQ ID NO: 30064
  Payload ID: 5883
  Gene Symbol: FAM214A
  Gene Name: family with sequence similarity 214, member A
  Uniprot ID: Q32MH5
  ENSP ID: ENSP00000484641

SEQ ID NO: 30077 - protein, 538 aa, Homo sapiens
  Payload ID: 5884
  Gene Symbol: FAM214B
  Gene Name: family with sequence similarity 214, member B
  Uniprot ID: Q7L5A3
  ENSP ID: ENSP00000319897
MRHVQAEPSPSSEPEAGPSQPPVRQGALQGGLLMGYSPAGGATSPGVYQVSIFSPPAGTSEPHRALKRQAPSTEGPRELKRGPGLGAREGLPPEEPSTVGLLGPEGPGLGLGVASQHFSHRGLCVVEQRSSVTSSWTSGAWSPPCPPSNASCNTLHTRDWASPDPGGQGSLGESPGPAPPGQLHTLDTDLHSLAQIGGKSPVAGVGNGGSLWPRESPGTANGHSPEHTPPGPGPPGPCPTKRRLLPAGEAPDVSSEEEGPAPRRRRGSLGHPTAANSSDAKATPFWSHLLPGPKEPVLDPTDCGPMGRRLKGARRLKLSPLRSLRKGPGLLSPPSASPVPTPAVSRTLLGNFEESLLRGRFAPSGHIEGFTAEIGASGSYCPQHVTLPVTVTFFDVSEQNAPAPFLGIVDLNPLGRKGYSVPKVGTVQVTLFNPNQTVVKMFLVTFDFSDMPAAHMTFLRHRLFLVPVGEEGNANPTHRLLCYLLHLRFRSSRSGRLSLHGDIRLLFSRRSLELDTGLPYELQAVTEAPHNPRYSPLP

SEQ ID NO: 30078 - protein, 538 aa, Homo sapiens; identical to SEQ ID NO: 30077
  Payload ID: 5884
  Gene Symbol: FAM214B
  Gene Name: family with sequence similarity 214, member B
  Uniprot ID: Q7L5A3
  ENSP ID: ENSP00000367819

SEQ ID NO: 30079 - protein, 538 aa, Homo sapiens; identical to SEQ ID NO: 30077
  Payload ID: 5884
  Gene Symbol: FAM214B
  Gene Name: family with sequence similarity 214, member B
  Uniprot ID: Q7L5A3
  ENSP ID: ENSP00000367823

SEQ ID NO: 30080 - protein, 233 aa, Homo sapiens
  Payload ID: 5884
  Gene Symbol: FAM214B
  Gene Name: family with sequence similarity 214, member B
  Uniprot ID: Q7L5A3
  ENSP ID: ENSP00000367829
MGRRLKGARRLKLSPLRSLRKGPGLLSPPSASPVPTPAVSRTLLGNFEESLLRGRFAPSGHIEGFTAEIGASGSYCPQHVTLPVTVTFFDVSEQNAPAPFLGIVDLNPLGRKGYSVPKVGTVQVTLFNPNQTVVKMFLVTFDFSDMPAAHMTFLRHRLFLVPVGEEGNANPTHRLLCYLLHLRFRSSRSGRLSLHGDIRLLFSRRSLELDTGLPYELQAVTEAPHNPRYSPLP

SEQ ID NO: 30081 - protein, 538 aa, Homo sapiens; identical to SEQ ID NO: 30077
  Payload ID: 5884
  Gene Symbol: FAM214B
  Gene Name: family with sequence similarity 214, member B
  Uniprot ID: Q7L5A3
  ENSP ID: ENSP00000474335

SEQ ID NO: 30082 - protein, 538 aa, Homo sapiens; identical to SEQ ID NO: 30077
  Payload ID: 5884
  Gene Symbol: FAM214B
  Gene Name: family with sequence similarity 214, member B
  Uniprot ID: Q7L5A3
  ENSP ID: ENSP00000474833

SEQ ID NO: 30083 - protein, 538 aa, Homo sapiens; identical to SEQ ID NO: 30077
  Payload ID: 5884
  Gene Symbol: FAM214B
  Gene Name: family with sequence similarity 214, member B
  Uniprot ID: Q7L5A3
  ENSP ID: ENSP00000475120

SEQ ID NO: 30084 - protein, 273 aa, Homo sapiens
  Payload ID: 5885
  Gene Symbol: FAM216A
  Gene Name: family with sequence similarity 216, member A
  Uniprot ID: Q8WUB2
  ENSP ID: ENSP00000366901
MLGQLLPHTARGLGAAEMPGQGPGSDWTERSSSAEPPAVAGTEGGGGGSAGYSCYQNSKGSDRIKDGYKVNSHIAKLQELWKTPQNQTIHLSKSMMEASFFKHPDLTTGQKRYLCSIAKIYNANYLKMLMKRQYMHVLQHSSQKPGVLTHHRSRLSSRYSQKQHYPCTTWRHQLEREDSGSSDIAAASAPEMLIQHSLWRPVRNKEGIKTGYASKTRCKSLKIFRRPRKLFMQTVSSDDSESHMSEEKKEEDLLNNFMQSMSIEEQGEHLMLT

SEQ ID NO: 30085 - protein, 77 aa, Homo sapiens
  Payload ID: 5885
  Gene Symbol: FAM216A
  Gene Name: family with sequence similarity 216, member A
  ENSP ID: ENSP00000448777
MLGQLLPHTARGLGAAEMPGQGPGSDWTERSSSAEPPAVAGTEGGGGGSAGYSCYQNSKGSASRPHHRPEALPVQHC

SEQ ID NO: 30086 - protein, 139 aa, Homo sapiens
  Payload ID: 5886
  Gene Symbol: FAM216B
  Gene Name: family with sequence similarity 216, member B
  Uniprot ID: Q8N7L0
  ENSP ID: ENSP00000319336
MGQNWKRQQKLWNVPQLPFIRVPPSIYDTSLLKALNQGQQRYFYSIMRIYNSRPQWEALQTRYIHSLQHQQLLGYITQREALSYALVLRDSTKRASAKVAPQRTIPRKTSAMTRRCPSVLPVSVVLPRAQSKRRQVLRN

SEQ ID NO: 30087 - protein, 139 aa, Homo sapiens; identical to SEQ ID NO: 30086
  Payload ID: 5886
  Gene Symbol: FAM216B
  Gene Name: family with sequence similarity 216, member B
  Uniprot ID: Q8N7L0
  ENSP ID: ENSP00000445786

SEQ ID NO: 30088 - protein, 508 aa, Homo sapiens
  Payload ID: 5887
  Gene Symbol: FAM217A
  Gene Name: family with sequence similarity 217, member A
  Uniprot ID: Q8IXS0
  ENSP ID: ENSP00000274673
MGRRNENCANSLRVSNISQENLSHWNLDSEVPVSENKNLPAGRDGAAGGKINKNYLEIPVEQLMLEPNLSVHSQKSTQNSKQGIFQLWNCPLNEGSTIEKREFKKSSVETGFNVINHPIRVFTLNHPLTIASVDKQVGPYPGLPMPLGLCWPYADGDFFKNRNEIHVSSCSTIENNDGETLPAPNWNLKHGNSSVEENFTDESDLSENEKTNDTLLSYFKKVDLNLKPETIKNVEEPFTEEPNEVFPYPDFLPPPFSALDLHNLALSKSDNWKVTVDPAETSVEHLITRLLELERLQHMTIQKERPRLQTTFCTPAVTERPSSSKATPKVRQPKLCDSLSLQIPCVDKSQEKSKNNSGSCKLEQNALKRNWSNAGKYRWNSRPLSLKSSSTPKQLIETYDKNPKSSILSPCQELSFKPTIGHTNQSMVKMVSTRCLPWRSPMPVSPIPLTFPENQKEEIKAPKRNFGTKKKLYRQNIVLNRPFSIQKLNCLSPSLIAKDKCCSPIEQK

SEQ ID NO: 30089 - protein, 32 aa, Homo sapiens
  Payload ID: 5887
  Gene Symbol: FAM217A
  Gene Name: family with sequence similarity 217, member A
  ENSP ID: ENSP00000418339
MLEPNLSVHSQKSTQNSKQGIFQLWNCPLNEG

SEQ ID NO: 30090 - protein, 47 aa, Homo sapiens
  Payload ID: 5887
  Gene Symbol: FAM217A
  Gene Name: family with sequence similarity 217, member A
  ENSP ID: ENSP00000418500
MLEPNLSVHSQKSTQNSKQGIFQLWNCPLNEGSTIEKREFKKSSVET

SEQ ID NO: 30091 - protein, 383 aa, Homo sapiens
  Payload ID: 5888
  Gene Symbol: FAM217B
  Gene Name: family with sequence similarity 217, member B
  Uniprot ID: Q9NTX9
  ENSP ID: ENSP00000351040
MNAGPSWNKVQHSKNSSGKRQSKSQVPHASSQPRSSLTAVTQPTEEKLKESISPEARRKRNPLGSRCQGASGNKLFLDFQSMKIIKENADEDSASDLSDSERIPIPPSPLTPPDLNLRAEEIDPVYFDLHPGQGHTKPEYYYPNFLPSPFSSWDLRDMALLLNAENKTEAVPRVGGLLGKYIDRLIQLEWLQVQTVQCEKAKGGKARPPTAPGTSGALKSPGRSKLIASALSKPLPHQEGASKSGPSRKKAFHHEEIHPSHYAFETSPRPIDVLGGTRFCSQRQTLEMRTEEKKKKSSKSTKLQRWDLSGSGSSSKVETSGHIRVPKQAAVILDSADSCKASKTQAHAHPRKKGKAESCGHATVSSEKKLKTNGVKQNTYKLK

SEQ ID NO: 30092 - protein, 383 aa, Homo sapiens; identical to SEQ ID NO: 30091
  Payload ID: 5888
  Gene Symbol: FAM217B
  Gene Name: family with sequence similarity 217, member B
  Uniprot ID: Q9NTX9
  ENSP ID: ENSP00000354056

SEQ ID NO: 30093 - protein, 47 aa, Homo sapiens
  Payload ID: 5888
  Gene Symbol: FAM217B
  Gene Name: family with sequence similarity 217, member B
  ENSP ID: ENSP00000414543
MNAGPSWNKVQHSKNSSGKRQSKSQVPHASSQPRSSLTAVTQPTEEK

SEQ ID NO: 30094 - protein, 157 aa, Homo sapiens
  Payload ID: 5889
  Gene Symbol: FAM218A
  Gene Name: family with sequence similarity 218, member A
  Uniprot ID: Q96MZ4
  ENSP ID: ENSP00000427428
MEGCAVRRGSCPLLPGPSAWRASPAGWAGRAKLRSWCRASGLPNRPYTLTGGRHGSVSLLRHPGTTTFVQQRSLHQSWEKRIVFSACPVSRSWCPERNFSGSIPAVTPPKLPGHSKSEGPPGKVRKRTTIRSQPLFVTRTRGFGSAVGWLPLGSPVL

SEQ ID NO: 30095 - protein, 168 aa, Homo sapiens
  Payload ID: 5890
  Gene Symbol: FAM219A
  Gene Name: family with sequence similarity 219, member A
  Uniprot ID: Q8IW50
  ENSP ID: ENSP00000297620
MMEEIDRFQVPTAHSEMQPLDPAAASISDGDCDAREEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 30096 - protein, 156 aa, Homo sapiens
  Payload ID: 5890
  Gene Symbol: FAM219A
  Gene Name: family with sequence similarity 219, member A
  ENSP ID: ENSP00000368369
MEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDRCVWGLGGSWAAQRNLYSTSGLYRPHLLYCQNWDILQPESLQG

SEQ ID NO: 30097 - protein, 172 aa, Homo sapiens
  Payload ID: 5890
  Gene Symbol: FAM219A
  Gene Name: family with sequence similarity 219, member A
  ENSP ID: ENSP00000368371
MEEIDRFQDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEINQDLNIQLLKDGYRLDEIPDDEDLDLIPPKSVNPTCMCCQATSSTACHIQ

SEQ ID NO: 30098 - protein, 156 aa, Homo sapiens
  Payload ID: 5890
  Gene Symbol: FAM219A
  Gene Name: family with sequence similarity 219, member A
  ENSP ID: ENSP00000368372
MEEIDRFQDPAAASISDGDCDAREEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 30099 - protein, 164 aa, Homo sapiens
  Payload ID: 5890
  Gene Symbol: FAM219A
  Gene Name: family with sequence similarity 219, member A
  ENSP ID: ENSP00000368377
MEEIDRFQVPTAHSEMQPLDPAAASISDGDCDAREEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPNQVSPCSLIYFQEGVWKT

SEQ ID NO: 30100 - protein, 166 aa, Homo sapiens
  Payload ID: 5890
  Gene Symbol: FAM219A
  Gene Name: family with sequence similarity 219, member A
  ENSP ID: ENSP00000368380
MEEIDRFQVPTAHSEMQPLDPAAASISDGDCDAREEKQRELARKGSLKNGSMGSPVNQQPKKNNVMARTRLVVPNKGYSSLDQSPDEKPLVALDTDSDDDFDMSRYSSSGYSSAEINQDLNIQLLKDGYRLDEIPDDEDLDLIPPKSVNPTCMCCQATSSTACHIQ

SEQ ID NO: 30101 - protein, 183 aa, Homo sapiens
  Payload ID: 5890
  Gene Symbol: FAM219A
  Gene Name: family with sequence similarity 219, member A
  ENSP ID: ENSP00000368382
MEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEINQDLNIQLLKDGYRLDEIPDDEDLDLIPPKSVNPTCMCCQATSSTACHIQ

SEQ ID NO: 30102 - protein, 185 aa, Homo sapiens
  Payload ID: 5890
  Gene Symbol: FAM219A
  Gene Name: family with sequence similarity 219, member A
  Uniprot ID: Q8IW50
  ENSP ID: ENSP00000392452
MMEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 30103 - protein, 168 aa, Homo sapiens
  Payload ID: 5890
  Gene Symbol: FAM219A
  Gene Name: family with sequence similarity 219, member A
  ENSP ID: ENSP00000409737
MEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNP

SEQ ID NO: 30104 - protein, 198 aa, Homo sapiens
  Payload ID: 5891
  Gene Symbol: FAM219B
  Gene Name: family with sequence similarity 219, member B
  Uniprot ID: Q5XKK7
  ENSP ID: ENSP00000350260
MATAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSVKFNKGYTALSQSPDENLVSLDSDSDGELGSRYSSGYSSAEQVNQDVSRQLLQDGYHLDEIPDDEDLDLIPPKPMASSTCSCCWCCLGDSSSCTLQ

SEQ ID NO: 30105 - protein, 168 aa, Homo sapiens
  Payload ID: 5891
  Gene Symbol: FAM219B
  Gene Name: family with sequence similarity 219, member B
  ENSP ID: ENSP00000454277
MATAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSVKFNKGYTALSQSPDENLVSLDSDSDGELGSRYSSGYSSAEVNQDVSRQLLQDGYHLDEIPDDEDL

SEQ ID NO: 30106 - protein, 87 aa, Homo sapiens
  Payload ID: 5891
  Gene Symbol: FAM219B
  Gene Name: family with sequence similarity 219, member B
  ENSP ID: ENSP00000454553
MATAEPSGRALRLSTPGPRPSGARDRAPGAAGPPSGQIGNRALRLGERTPAAVEKRGPYMVTRAPSIQAKLQKHRDLAKAVLRRKGQ

SEQ ID NO: 30107 - protein, 69 aa, Homo sapiens
  Payload ID: 5891
  Gene Symbol: FAM219B
  Gene Name: family with sequence similarity 219, member B
  ENSP ID: ENSP00000454600
  MOD_RES (1)..(1): Any amino acid
XVLRRKGMLGASPNRPDSSGKRSVKFNKGYTALSQSPDENLVSLDSDRPFMYIPGPFSSEQYPFPGWLG

SEQ ID NO: 30108 - protein, 198 aa, Homo sapiens; identical to SEQ ID NO: 30104
  Payload ID: 5891
  Gene Symbol: FAM219B
  Gene Name: family with sequence similarity 219, member B
  Uniprot ID: Q5XKK7
  ENSP ID: ENSP00000454719

SEQ ID NO: 30109 - protein, 73 aa, Homo sapiens
  Payload ID: 5891
  Gene Symbol: FAM219B
  Gene Name: family with sequence similarity 219, member B
  ENSP ID: ENSP00000454832
MATAEPSGRALRLSTPGPRPSGARDRAPGAAGPPSGQIGNRALRLGERTPAAVEKRGPYMVTRAPSIQAKLRQ

SEQ ID NO: 30110 - protein, 112 aa, Homo sapiens
  Payload ID: 5891
  Gene Symbol: FAM219B
  Gene Name: family with sequence similarity 219, member B
  ENSP ID: ENSP00000455248
MLGASPNRPDSSGKRSVKFNKGYTALSQSPDENLVSLDSDSDGELGSRYSSGYSSAEQVNQDVSRQLLQDGYHLDEIPDDEDLDLIPPKPMASSTCSCCWCCLGDSSSCTLQ

SEQ ID NO: 30111 - protein, 196 aa, Homo sapiens
  Payload ID: 5891
  Gene Symbol: FAM219B
  Gene Name: family with sequence similarity 219, member B
  ENSP ID: ENSP00000456404
  MOD_RES (1)..(1): Any amino acid
XAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSVKFNKGYTALSQSPDENLVSLDSDSDGELGSRYSSGYSSAEQVNQDVSRQLLQDGYHLDEIPDDEDLDLIPPKPMASSTCSCCWCCLGDSSSCTLQ

SEQ ID NO: 30112 - protein, 73 aa, Homo sapiens; identical to SEQ ID NO: 30109
  Payload ID: 5891
  Gene Symbol: FAM219B
  Gene Name: family with sequence similarity 219, member B
  ENSP ID: ENSP00000456406

SEQ ID NO: 30113 - protein, 131 aa, Homo sapiens
  Payload ID: 5891
  Gene Symbol: FAM219B
  Gene Name: family with sequence similarity 219, member B
  ENSP ID: ENSP00000456744
MATAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSVKFNKGYTALSQSPDENLVSLDSDRAVLF

SEQ ID NO: 30114 - protein, 73 aa, Homo sapiens; identical to SEQ ID NO: 30109
  Payload ID: 5891
  Gene Symbol: FAM219B
  Gene Name: family with sequence similarity 219, member B
  ENSP ID: ENSP00000457328

SEQ ID NO: 30115 - protein, 148 aa, Homo sapiens
  Payload ID: 5891
  Gene Symbol: FAM219B
  Gene Name: family with sequence similarity 219, member B
  Uniprot ID: Q5XKK7
  ENSP ID: ENSP00000457594
MATAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSVKFNKGYTALSQSPDENLVSLDSDRPFMYIPGPFSSEQYPFPGWLG

SEQ ID NO: 30116 - protein, 10 aa, Homo sapiens
  Payload ID: 5891
  Gene Symbol: FAM219B
  Gene Name: family with sequence similarity 219, member B
  ENSP ID: ENSP00000457778
EQYPFPGWLG

SEQ ID NO: 30117 - protein, 73 aa, Homo sapiens; identical to SEQ ID NO: 30109
  Payload ID: 5891
  Gene Symbol: FAM219B
  Gene Name: family with sequence similarity 219, member B
  ENSP ID: ENSP00000457861

SEQ ID NO: 30118 - protein, 73 aa, Homo sapiens; identical to SEQ ID NO: 30109
  Payload ID: 5891
  Gene Symbol: FAM219B
  Gene Name: family with sequence similarity 219, member B
  ENSP ID: ENSP00000457998

SEQ ID NO: 30119 - protein, 259 aa, Homo sapiens
  Payload ID: 5892
  Gene Symbol: FAM220A
  Gene Name: family with sequence similarity 220, member A
  Uniprot ID: Q7Z4H9
  ENSP ID: ENSP00000317289
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPAPTECFARVSCSGVEALGRRDWLGGGPRATDGHRGQCPKGEPRVSRLPRHQKVPEMGSFQDDPPSAFPKGLGSELEPACLHSILSATLHVYPEVLLSEETKRIFLDRLKPMFSKQTIEFKKMLKSTSDGLQITLGLLALQPFELANTLCHS

SEQ ID NO: 30120 - protein, 120 aa, Homo sapiens
  Payload ID: 5892
  Gene Symbol: FAM220A
  Gene Name: family with sequence similarity 220, member A
  ENSP ID: ENSP00000432444
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPAPTECFARVSCS

SEQ ID NO: 30121 - protein, 109 aa, Homo sapiens
  Payload ID: 5892
  Gene Symbol: FAM220A
  Gene Name: family with sequence similarity 220, member A
  ENSP ID: ENSP00000436886
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPA

SEQ ID NO: 30122 - protein, 68 aa, Homo sapiens
  Payload ID: 5892
  Gene Symbol: FAM220A
  Gene Name: family with sequence similarity 220, member A
  ENSP ID: ENSP00000464009
MAAALSGLAVRLSRSAAARSYGVFCKGLTRTLLIFFDLAWRLRINFPYLYIVASMMLNVRLQVHIEIH

SEQ ID NO: 30123 - protein, 259 aa, Homo sapiens; identical to SEQ ID NO: 30119
  Payload ID: 5892
  Gene Symbol: FAM220A
  Gene Name: family with sequence similarity 220, member A
  Uniprot ID: Q7Z4H9
  ENSP ID: ENSP00000483140

SEQ ID NO: 30124 - protein, 298 aa, Homo sapiens
  Payload ID: 5893
  Gene Symbol: FAM221A
  Gene Name: family with sequence similarity 221, member A
  Uniprot ID: A4D161
  ENSP ID: ENSP00000342576
MERLTLPLGGAAAVDEYLEYRRIVGEDDGGKLFTPEEYEEYKRKVLPLRLQNRLFVSWRSPTGMDCKLVGPETLCFCTHRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIGVPSVEFLESPITAVDSPFLKAFQASSSSSPETLTDVGTSSQVSSLRRPEEDDMAFFERRYQERMKMEKAAKWKGKAPLPSATKPS

SEQ ID NO: 30125 - protein, 204 aa, Homo sapiens
  Payload ID: 5893
  Gene Symbol: FAM221A
  Gene Name: family with sequence similarity 221, member A
  Uniprot ID: A4D161
  ENSP ID: ENSP00000386631
MERLTLPLGGAAAVDEYLEYRRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIVGTSSQVSSLRRPEEDDMAFFERRYQERMKMEKAAKWKGKAPLPSATKPS

SEQ ID NO: 30126 - protein, 240 aa, Homo sapiens
  Payload ID: 5893
  Gene Symbol: FAM221A
  Gene Name: family with sequence similarity 221, member A
  ENSP ID: ENSP00000386900
MERLTLPLGGAAAVDEYLEYRRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIGVPSVEFLESPITAVDSPFLKAFQASSSSSPETLTDVGTSSQVSSLRRPEEDDMAFFERRYQERMKMEKAAKWKGKAPLPSATKPS

SEQ ID NO: 30127 - protein, 262 aa, Homo sapiens
  Payload ID: 5893
  Gene Symbol: FAM221A
  Gene Name: family with sequence similarity 221, member A
  Uniprot ID: A4D161
  ENSP ID: ENSP00000386927
MERLTLPLGGAAAVDEYLEYRRIVGEDDGGKLFTPEEYEEYKRKVLPLRLQNRLFVSWRSPTGMDCKLVGPETLCFCTHRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIVGTSSQVSSLRRPEEDDMAFFERRYQERMKMEKAAKWKGKAPLPSATKPS

SEQ ID NO: 30128 - protein, 98 aa, Homo sapiens
  Payload ID: 5893
  Gene Symbol: FAM221A
  Gene Name: family with sequence similarity 221, member A
  ENSP ID: ENSP00000404551
MERLTLPLGGAAAVDEYLEYRRIVGEDDGGKLFTPEEYEEYKRKVLPLRLQNRLFVSWRSPTGMDCKLVGPETLCFCTHSRDGGFHRVSQDGLDLLTL

SEQ ID NO: 30129 - protein, 114 aa, Homo sapiens
  Payload ID: 5893
  Gene Symbol: FAM221A
  Gene Name: family with sequence similarity 221, member A
  ENSP ID: ENSP00000416525
MERLTLPLGGAAAVDEYLEYRRIVGEDDGGKLFTPEEYEEYKRKVLPLRLQNRLFVSWRSPTGMDCKLVGPETLCFCTHRVLLCHSGWSAVARSWLIAASTSWAQAILRPQPPK

SEQ ID NO: 30130 - protein, 301 aa, Homo sapiens
  Payload ID: 5894
  Gene Symbol: FAM221B
  Gene Name: family with sequence similarity 221, member B
  ENSP ID: ENSP00000367222
MEAHEIIEEPHITMDAEKHPPSKDPSAEDLQENHISESFLKPSTSETPLEPHTSESPLVPSPSQIPLEAHSPETHQEPSISETPSETPTYEASLDSPISVVPEKHLTLPPQSRDYVCLSSSDTLKEDLSSESSSNEVPWTRRSTHLSESESLPEHCLSGPSSQVQVDTTEKQEEEAGEVEKGVDASDSTAHTAQPGHQLGNTARPVFPARQTELVEVAKAMHREEFGAQVNNLFQWEKDAALNAIQTGLYIGWRCPHYLWDCFRIGDESRCFCGHLLREHRIISDISVPCKVSQCRCFMFC

SEQ ID NO: 30131 - protein, 340 aa, Homo sapiens
  Payload ID: 5894
  Gene Symbol: FAM221B
  Gene Name: family with sequence similarity 221, member B
  Uniprot ID: A6H8Z2
  ENSP ID: ENSP00000373602
MEAHEIIEEPHITMDAEKHPPSKDPSAEDLQENHISESFLKPSTSETPLEPHTSESPLVPSPSQIPLEAHSPETHQEPSISETPSETPTYEASLDSPISVVPEKHLTLPPQSRDYVCLSSSDTLKEDLSSESSSNEVPWTRRSTHLSESESLPEHCLSGPSSQVQVDTTEKQEEEAGEVEKGVDASDSTAHTAQPGHQLGNTARPVFPARQTELVEVAKAMHREEFGAQVNNLFQWEKDAALNAIQTDRIRNSSSGILAPAHLHCDCLYLALSTKPPWCKGALALQAISIKTEEAKPKATSRQALDPDRLWVSTLAGAAPITYGTVSGLGMSPDAFVDTC

SEQ ID NO: 30132 - protein, 402 aa, Homo sapiens
  Payload ID: 5894
  Gene Symbol: FAM221B
  Gene Name: family with sequence similarity 221, member B
  Uniprot ID: A6H8Z2
  ENSP ID: ENSP00000415299
MEAHEIIEEPHITMDAEKHPPSKDPSAEDLQENHISESFLKPSTSETPLEPHTSESPLVPSPSQIPLEAHSPETHQEPSISETPSETPTYEASLDSPISVVPEKHLTLPPQSRDYVCLSSSDTLKEDLSSESSSNEVPWTRRSTHLSESESLPEHCLSGPSSQVQVDTTEKQEEEAGEVEKGVDASDSTAHTAQPGHQLGNTARPVFPARQTELVEVAKAMHREEFGAQVNNLFQWEKDAALNAIQTGLYIGWRCPHYLWDCFRIGDESRCFCGHLLREHRIISDISVPCKVSQCRCFMFCFIPSRPEEVGEFWLKRRATFDPKAWRAQCRCKHSHEEHAATGPHPCRHHGCCCGCFESNFLCAACDRRWEEHETFFDTQKTRQRGGRPRGTDTVSNWHRPL

SEQ ID NO: 30133 - protein, 90 aa, Homo sapiens
  Payload ID: 5894
  Gene Symbol: FAM221B
  Gene Name: family with sequence similarity 221, member B
  ENSP ID: ENSP00000420279
MEAHEIIEEPHITMDAEKHPPSKDPSAEDLQENHISESFLKPSTSETPLEPHTSESPLVPSPSQIPLEAHSPETHQEPSISETPSETPTY

SEQ ID NO: 30134 - protein, 452 aa, Homo sapiens
  Payload ID: 5895
  Gene Symbol: FAM222A
  Gene Name: family with sequence similarity 222, member A
  Uniprot ID: Q5U5X8
  ENSP ID: ENSP00000351783
MLACLQRTQNAPGQHLACPSKSLELRKCEAVASAMHSSRYPSPAELDAYAEKVANSPLSIKIFPTNIRVPQHKHLSRTVNGYDTSGQRYSPYPQHTAGYQGLLAIVKAAVSSSSTAAPAGPAKSVLKSAEGKRTKLSPAAVQVGIAPYPVPSTLGPLAYPKPPEAPAPPPGLPAAATAASVIPLPGRGLPLPPSNLPSIHSLLYQLNQQCQAPGAAPPACQGMAIPHPSPAKHGPVPSFPSMAYSAAAGLPDCRKGTELGQGATQALTLAGAAKPAGYADSGLDYLLWPQKPPPPPPQPLRAYSGSTVASKSPEACGGRAYERASGSPLNCGVGLPTSFTVGQYFAAPWNSVLVTPTSDCYNPAAAVVVTELGPGAARELAGPPADALSGLPSKSVCNTSVLSSSLQSLEYLINDIRPPCIKEQMLGKGYETVAVPRLLDHQHAHIRLPVYR

SEQ ID NO: 30135 - protein, 452 aa, Homo sapiens; identical to SEQ ID NO: 30134
  Payload ID: 5895
  Gene Symbol: FAM222A
  Gene Name: family with sequence similarity 222, member A
  Uniprot ID: Q5U5X8
  ENSP ID: ENSP00000443292

SEQ ID NO: 30136 - protein, 434 aa, Homo sapiens
  Payload ID: 5896
  Gene Symbol: FAM222B
  Gene Name: family with sequence similarity 222, member B
  ENSP ID: ENSP00000343115
MNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAPPNVTVSTSTIPLSMAATLQHSQPPDLSSIVHQINQFCQTRAGISTTSVCEGQIANPSPISRSLLINASTRVSTHSVPTPMPSCVVNPMEHTHAATAALPAAGPVNLPTGISRVPTGYPSDLKPVTWNQHQLAHLQQMCSEASGTPAPGLTGKHAAGRELAGPGFVGKAPAYPQELCLAQSFHLKPPLEKPTPSPPVNGMAAPLAYPNGHYFQPLWNNILPTPNSDSSGSQDLAMPFHGGQPTGAPLDCAAAPGAHYRAGTGGGPVASQNSLMQTVDYLSGDFQQACFREQSLAMLSKAHRAPGNRAPDPTESRSLHIQHPGYR

SEQ ID NO: 30137 - protein, 562 aa, Homo sapiens
  Payload ID: 5896
  Gene Symbol: FAM222B
  Gene Name: family with sequence similarity 222, member B
  Uniprot ID: Q8WU58
  ENSP ID: ENSP00000413645
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAPPNVTVSTSTIPLSMAATLQHSQPPDLSSIVHQINQFCQTRAGISTTSVCEGQIANPSPISRSLLINASTRVSTHSVPTPMPSCVVNPMEHTHAATAALPAAGPVNLPTGISRVPTGYPSDLKPVTWNQHQLAHLQQMCSEASGTPAPGLTGKHAAGRELAGPGFVGKAPAYPQELCLAQSFHLKPPLEKPTPSPPVNGMAAPLAYPNGHYFQPLWNNILPTPNSDSSGSQDLAMPFHGGQPTGAPLDCAAAPGAHYRAGTGGGPVASQNSLMQTVDYLSGDFQQACFREQSLAMLSKAHRAPGNRAPDPTESRSLHIQHPGYR

SEQ ID NO: 30138 - protein, 28 aa, Homo sapiens
  Payload ID: 5896
  Gene Symbol: FAM222B
  Gene Name: family with sequence similarity 222, member B
  ENSP ID: ENSP00000462251
MLACLPGPGDLSFQLLSHTQMNTGLQKL

SEQ ID NO: 30139 - protein, 562 aa, Homo sapiens; identical to SEQ ID NO: 30137
  Payload ID: 5896
  Gene Symbol: FAM222B
  Gene Name: family with sequence similarity 222, member B
  Uniprot ID: Q8WU58
  ENSP ID: ENSP00000462419

SEQ ID NO: 30140 - protein, 28 aa, Homo sapiens
  Payload ID: 5896
  Gene Symbol: FAM222B
  Gene Name: family with sequence similarity 222, member B
  ENSP ID: ENSP00000462534
MLACLPGPGDLSFQLLSHTQMNTGLQKL

SEQ ID NO: 30141 - protein, 28 aa, Homo sapiens
  Payload ID: 5896
  Gene Symbol: FAM222B
  Gene Name: family with sequence similarity 222, member B
  ENSP ID: ENSP00000462540
MLACLPGPGDLSFQLLSHTQMNTGLQKL

SEQ ID NO: 30142 - protein, 28 aa, Homo sapiens
  Payload ID: 5896
  Gene Symbol: FAM222B
  Gene Name: family with sequence similarity 222, member B
  ENSP ID: ENSP00000463136
MLACLPGPGDLSFQLLSHTQMNTGLQKL

SEQ ID NO: 30143 - protein, 28 aa, Homo sapiens
  Payload ID: 5896
  Gene Symbol: FAM222B
  Gene Name: family with sequence similarity 222, member B
  ENSP ID: ENSP00000463278
MLACLPGPGDLSFQLLSHTQMNTGLQKL

SEQ ID NO: 30144 - protein, 239 aa, Homo sapiens
  Payload ID: 5896
  Gene Symbol: FAM222B
  Gene Name: family with sequence similarity 222, member B
  ENSP ID: ENSP00000463296
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAP

SEQ ID NO: 30145 - protein, 136 aa, Homo sapiens
  Payload ID: 5896
  Gene Symbol: FAM222B
  Gene Name: family with sequence similarity 222, member B
  ENSP ID: ENSP00000463642
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPY

SEQ ID NO: 30146 - protein, 28 aa, Homo sapiens
  Payload ID: 5896
  Gene Symbol: FAM222B
  Gene Name: family with sequence similarity 222, member B
  ENSP ID: ENSP00000463753
MLACLPGPGDLSFQLLSHTQMNTGLQKL

SEQ ID NO: 30147 - protein, 43 aa, Homo sapiens
  Payload ID: 5896
  Gene Symbol: FAM222B
  Gene Name: family with sequence similarity 222, member B
  ENSP ID: ENSP00000464019
MLACLPGPGDLSFQLLSHTQMNTGLQKWDTTQKMRTAHYPTPA

SEQ ID NO: 30148 - protein, 54 aa, Homo sapiens
  Payload ID: 5896
  Gene Symbol: FAM222B
  Gene Name: family with sequence similarity 222, member B
  ENSP ID: ENSP00000464291
MLACLPGPGDLSFQLLSHTQMNTGLQKSLFTISASVEAGQRKLINVDKCPLPYS

SEQ ID NO: 30149 - protein, 136 aa, Homo sapiens; identical to SEQ ID NO: 30145
  Payload ID: 5896
  Gene Symbol: FAM222B
  Gene Name: family with sequence similarity 222, member B
  ENSP ID: ENSP00000464299

SEQ ID NO: 30150 - protein, 179 aa, Homo sapiens
  Payload ID: 5896
  Gene Symbol: FAM222B
  Gene Name: family with sequence similarity 222, member B
  ENSP ID: ENSP00000464355
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPYATVAPSTLAHPQAQALARQQALQHAQTLAHAPPQTLQHPQGIP

SEQ ID NO: 30151 - protein, 646 aa, Homo sapiens
  Payload ID: 5897
  Gene Symbol: FAM227A
  Gene Name: family with sequence similarity 227, member A
  ENSP ID: ENSP00000348086
MEVINLTTLPMIPVDEHLAVSLVARNTMVKTVRKELENNPPSCLIGSMHQVNQKIADINLRTEPSANSLAIERFELEKKALREKTRSSPEDKVKRQRKSQYSCKGSELRHARSSVIKRKTADKNLLAELYQYSNFNSSKPNKLPNGVDFCDMVGNVVRAERDCLSGKHFCSGRELEKFLSSSSPRAIWLDSFWWIFHERYQPNKELQNNLFDRIAQHYALLLFRVPKSHSEEALLKRLPSLLSKAVYTSFCCCFPQSWFDTHEFKSDICNTMSLWISGGTYPSPQSYDSWDYSELDPERFRREELMLYRRRLTKGREFSLFAGKRAFSQKPAQSRKFYHPQSSSANSPSEKTSSAKQNSEKSLRMQNTAKEHHCQTLVLKKPTQEVKRISEARECENMFPKKSCAACKSPELTSNLFNIYGKSPLIVYFLQNYASLQQHGKNVLIVRREKTTSTPDCTPTYTDVISETLCSMKKRKDNLNQLYQHHWTEWNYFDKHLKELQDNFSREMKNIDPKAADTKKANHMFIPPSAVNEESPDKKTKGSLQREIEFKGCSNKNHGKGRSVNMRGKEEREREEKQKLNISFHSLPSPEELHNLEPGSAYRIRDISATRTPLRRPSSWEPSLIYQEQVLLKTHTLSMEEDKFRC

SEQ ID NO: 30152 - protein, 570 aa, Homo sapiens
  Payload ID: 5897
  Gene Symbol: FAM227A
  Gene Name: family with sequence similarity 227, member A
  Uniprot ID: F5H4B4
  ENSP ID: ENSP00000445093
MNHFRKMEVINLTTLPMIPVDEHLAVSLVARNTMVKTVRKELENNPPSCLIGSMHQVNQKIADINLRTEPSANSLAIERFELEKKALREKTRSSPEDKVKRQRKSQYSCKGSELRHARSSVIKRKTADKNLLAELYQYSNFNSSKPNKLPNGVDFCDMVGNVVRAERDCLSGKHFCSGRELEKFLSSSSPRAIWLDSFWWIFHERYQPNKELQNNLFDRIAQHYALLLFRVPKSHSEEALLKRLPSLLSKAVYTSFCCCFPQSWFDTHEFKSDICNTMSLWISGTYPSPQSYDSWDYSELDPERFRREELMLYRRRLTKGREFSLFAGKRAFSQKPAQSRKFYHPQSSSANSPSEKTSSAKQNSEKSLRMQNTAKEHHCQTLVLKKPTQEVKRISEARECENMFPKKSCAACKSPELTSNLFNIYGKSPLIVYFLQNYASLQQHGKNVLIVRREKTTSTPDCTPTYTDVISETLCSMKKRKDNLNQLYQHHWTEWNYFDKHLKELQDNFSREMKNIDPKAADTKKANHMFIPPSAVNEESPDKKTKEGKGGEGKRRETEVEHFFPLTSKP

SEQ ID NO: 30153 - protein, 508 aa, Homo sapiens
  Payload ID: 5898
  Gene Symbol: FAM227B
  Gene Name: family with sequence similarity 227, member B
  Uniprot ID: Q96M60
  ENSP ID: ENSP00000299338
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLFILKAHNFDERVFKIWKTHFLSEASIALLHDSFWWWFLHKFRPDRENQDCLFDRISESYVTLFMSIPLSRKDAFFQIYPDCLAQAIYATFHEAFPESSYLFNDEFKEDLGNNIFLWCSGLKPQKGFWIHWKLKELSTTTIHGSKKAPAKSVKERIADSQEHISTSIDFNIIKILNNPRAYTLPISKEESRLSRLATKSHYSSTGPEFNRVLFNFGGQSPLILYYLKMHELAGISKAPKKTKIKLTKIFQEPLPAPTYRDVIKEAKRQFARNQKDFRILQAKATKKPHEVKQDFEKFLHKLRSEAEIERECVASLSSSSSSSPSSTDNYNFEEEEY

SEQ ID NO: 30154 - protein, 166 aa, Homo sapiens
  Payload ID: 5898
  Gene Symbol: FAM227B
  Gene Name: family with sequence similarity 227, member B
  ENSP ID: ENSP00000452616
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMGVWGMGPHSVAQAGVQWRNRGSLQPLPPRFK

SEQ ID NO: 30155 - protein, 304 aa, Homo sapiens
  Payload ID: 5898
  Gene Symbol: FAM227B
  Gene Name: family with sequence similarity 227, member B
  Uniprot ID: Q96M60
  ENSP ID: ENSP00000453028
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLFILKAHNFDERVFKIWKTHFLSEASIALLHDSFWWWFLHKFRIYPDCLAQAIYATFHEAFPESSYLFNDEFKEDLGNNIFLWCSGLKPQKGFWIHWKLKELSTTTIHGSKKAPAKSVKERIADSQEHISTS

SEQ ID NO: 30156 - protein, 182 aa, Homo sapiens
  Payload ID: 5898
  Gene Symbol: FAM227B
  Gene Name: family with sequence similarity 227, member B
  ENSP ID: ENSP00000453379
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLFILKAHNFD

SEQ ID NO: 30157 - protein, 47 aa, Homo sapiens
  Payload ID: 5898
  Gene Symbol: FAM227B
  Gene Name: family with sequence similarity 227, member B
  ENSP ID: ENSP00000453748
MAGQRTCQRRSSRAGPGKMQEPPKSIEEFLKFQNWVLIENWNDMGNF

SEQ ID NO: 30158 - protein, 134 aa, Homo sapiens
  Payload ID: 5898
  Gene Symbol: FAM227B
  Gene Name: family with sequence similarity 227, member B
  ENSP ID: ENSP00000453787
  MOD_RES (1)..(1): Any amino acid
XKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLFILKAHNFDVCKYFILL

SEQ ID NO: 30159 - protein, 178 aa, Homo sapiens
  Payload ID: 5898
  Gene Symbol: FAM227B
  Gene Name: family with sequence similarity 227, member B
  ENSP ID: ENSP00000454081
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMLSDEMETEKNIEGVWGMGPHSVAQAGVQWRNRGSLQPLPPRFK

SEQ ID NO: 30160 - protein, 206 aa, Homo sapiens
  Payload ID: 5899
  Gene Symbol: FAM228A
  Gene Name: family with sequence similarity 228, member A
  Uniprot ID: Q86W67
  ENSP ID: ENSP00000295150
MAATKTASYDEHFRPEKLREWPEPESVSLMEVLAREDIDEAVCAILFKENSIVKVTVPPFVDPLFQRQQEVDEERRTGLQCETGKRHSIKELEEIEKARLHASSPYFTFTSHCVIPKEWHKASARARSKTYKYSPEKLIYADKKQKRKEKKTADLSQAAFERQFLSSKLSQKNKVGERKGLVSRGLGRGWHAGLCSTHEQHILVPE

SEQ ID NO: 30161 - protein, 106 aa, Homo sapiens
  Payload ID: 5899
  Gene Symbol: FAM228A
  Gene Name: family with sequence similarity 228, member A
  ENSP ID: ENSP00000401257
MAATKTASYDEHFRPEKLREWPEPESVSLMEVLAREDIDEAVCAILFKENSIVKRLDMYFQHVDTFKERRKEMLHKKWVENVAEPLQQRIMEKVISYKELKMKREC

SEQ ID NO: 30162 - protein, 210 aa, Homo sapiens
  Payload ID: 5899
  Gene Symbol: FAM228A
  Gene Name: family with sequence similarity 228, member A
  ENSP ID: ENSP00000412833
  MOD_RES (1)..(1): Any amino acid
XATKTASYDEHFRPEKLREWPEPESVSLMEVLAREDIDEAVCAILFKENSIVKRLDMYFQHVDTFKERRKEMLHKKWVENVAEPLQQRIMEKVTVPPFVDPLFQRQQEVDEERRTGLQCETGKRHSIKELEEIEKARLHASSPYFTFTSHCVIPKEWHKASARARSKTYKYSPEKLIYADKKQKRKEKKTADLSQAAFERQFLSSKLSQK

SEQ ID NO: 30163 - protein, 136 aa, Homo sapiens
  Payload ID: 5899
  Gene Symbol: FAM228A
  Gene Name: family with sequence similarity 228, member A
  ENSP ID: ENSP00000416595
LHASSPYFTFTSHCVIPKEWHKASARARSKTYKYSPEKLIYADKKQKRKEKKTADLSQAAFERQFLSSKLSQKNKVGERKGLVLGTRQQRPRSWAAGDSQQHRGPQPVGKRVMTAEVLGQHLASLQKVARQGHPWY

SEQ ID NO: 30164 - protein, 74 aa, Homo sapiens
  Payload ID: 5900
  Gene Symbol: FAM228B
  Gene Name: family with sequence similarity 228, member B
  ENSP ID: ENSP00000478228
MKNVDSDDLVTGTLPKLKSSKEWLEPKPLCFMEVLAKEDTEAAIQSILYKENSVIKKQRVILSRKRTAVLSGGK

SEQ ID NO: 30165 - protein, 187 aa, Homo sapiens
  Payload ID: 5900
  Gene Symbol: FAM228B
  Gene Name: family with sequence similarity 228, member B
  ENSP ID: ENSP00000479742
MSKKDPNFLKVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLSQEREEDQDGSPSPRLGLLKLEL

SEQ ID NO: 30166 - protein, 324 aa, Homo sapiens
  Payload ID: 5900
  Gene Symbol: FAM228B
  Gene Name: family with sequence similarity 228, member B
  ENSP ID: ENSP00000482482
MKNVDSDDLVTGTLPKLKSSKEWLEPKPLCFMEVLAKEDTEAAIQSILYKENSVIKELDKYLQHHAFLNARRKEMLYKRWVDCVADPLQKKIIEKVCSHKKIKKRRQGELDGFLKHVNKKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLSQEREEDQDGSPSPRLGLLKLEL

SEQ ID NO: 30167 - protein, 108 aa, Homo sapiens
  Payload ID: 5900
  Gene Symbol: FAM228B
  Gene Name: family with sequence similarity 228, member B
  ENSP ID: ENSP00000482759
YSIKEFKEVEKVQLHSRFPQISNSRHFITPNEWLKLPTRYIESEFCRRRRNKGSSFLEREPLCYQEGNNPSAKEAISEGYFSSLSLSQEREEDQDGSSLCRCDHPSNS

SEQ ID NO: 30168 - protein, 38 aa, Homo sapiens
  Payload ID: 5900
  Gene Symbol: FAM228B
  Gene Name: family with sequence similarity 228, member B
  ENSP ID: ENSP00000482790
PSAKEAISEGYFSSLSLSQEREEDQDGFQQPRSTHPDP

SEQ ID NO: 30169 - protein, 324 aa, Homo sapiens; identical to SEQ ID NO: 30166
  Payload ID: 5900
  Gene Symbol: FAM228B
  Gene Name: family with sequence similarity 228, member B
  ENSP ID: ENSP00000483011

SEQ ID NO: 30170 - protein, 52 aa, Homo sapiens
  Payload ID: 5901
  Gene Symbol: FAM229A
  Gene Name: family with sequence similarity 229, member A
  ENSP ID: ENSP00000454338
FPIEAGDSRGLAAAPESQDSPEAVATEHNPVSGPCRASISPGRFVAALDATA

SEQ ID NO: 30171 - protein, 127 aa, Homo sapiens
  Payload ID: 5901
  Gene Symbol: FAM229A
  Gene Name: family with sequence similarity 229, member A
  Uniprot ID: H3BQW9
  ENSP ID: ENSP00000455971
MLPSSTPGPGHATETCPAPPGPERSPAARAPAAASSLGPVSTAGRAPRGLDMSAQEPPQGRRFPIEAGDSRGLAAAPESQDSPEAVATEHNPVRPLRRCPGCHCLTLLHVPIDVYLAMGGSPRARAT

SEQ ID NO: 30172 - protein, 80 aa, Homo sapiens
  Payload ID: 5902
  Gene Symbol: FAM229B
  Gene Name: family with sequence similarity 229, member B
  Uniprot ID: Q4G0N7
  ENSP ID: ENSP00000357645
MPFQFGTQPRRFPVEGGDSSIELEPGLSSSAACNGKEMSPTRQLRRCPGSHCLTITDVPVTVYATTRKPPAQSSKEMHPK

SEQ ID NO: 30173 - protein, 80 aa, Homo sapiens; identical to SEQ ID NO: 30172
  Payload ID: 5902
  Gene Symbol: FAM229B
  Gene Name: family with sequence similarity 229, member B
  Uniprot ID: Q4G0N7
  ENSP ID: ENSP00000474987

SEQ ID NO: 30174 - protein, 169 aa, Homo sapiens
  Payload ID: 5903
  Gene Symbol: FAM231A
  Gene Name: family with sequence similarity 231, member A
  Uniprot ID: P0DMU4
  ENSP ID: ENSP00000408511
MVSSKGLWKERPSAHTSECFSTTACPVAFILLVWNSQTPAGLQSLCTGRHPSLSARAQRAGPRASREEGTFWTERVGQERWLIRSGSSQNESQEDQGAGLISQAGLKADNRRESSTWANEVEDRRPQCTPALNLTPSHPHPPHSLTTFLRSVIGIQIPPGLVAAGGTVA

SEQ ID NO: 30175 - protein, 169 aa, Homo sapiens; identical to SEQ ID NO: 30174
  Payload ID: 5904
  Gene Symbol: FAM231B
  Gene Name: family with sequence similarity 231, member B
  Uniprot ID: A6NCW3
  ENSP ID: ENSP00000473163

SEQ ID NO: 30176 - protein, 169 aa, Homo sapiens
  Payload ID: 5905
  Gene Symbol: FAM231C
  Gene Name: family with sequence similarity 231, member C
  Uniprot ID: P0DMU5
  ENSP ID: ENSP00000470910
MGCSKGLWKERPSAHTSECFSTTACPVAFILLVWNSQSPAGLQSFCTGRHPSLSVRAQRAGTGASREEGTFWTECVGQERRLIHSGSSENESQEDEGADLIPYTGLKADNRRKSSTWANEVEDRRPQSTPALNLTPSHPHPPRPLITFLRSVIGIQIPPGLVAAGGTVA

SEQ ID NO: 30177 - protein, 169 aa, Homo sapiens; identical to SEQ ID NO: 30174
  Payload ID: 5906
  Gene Symbol:
  Gene Name: family with sequence similarity 231, member C [Source:EntrezGene
  Acc:729587]
  Uniprot ID: P0DMU3
  ENSP ID: ENSP00000485366

SEQ ID NO: 30178 - protein, 169 aa, Homo sapiens
  Payload ID: 5907
  Gene Symbol: FAM231D
  Gene Name: family with sequence similarity 231, member D
  Uniprot ID: Q6ZW35
  ENSP ID: ENSP00000475227
MGSSKGLWKEKPSAHTSECFSTTACPVACILLVWNSQTPAGLQSLCTGRHPSLSARAQWAGPRASREEGTFWTEPVGQERRLIRSGSSQNESQEDQGADLISHEGLKADNRRESSTWANEVEDRRPQCTSALNLTPSHLHPPHPLTTFFRNVIGIKIPPGLVAMGGTVA

SEQ ID NO: 30179 - protein, 552 aa, Homo sapiens
  Payload ID: 5908
  Gene Symbol: FAM234A
  Gene Name: family with sequence similarity 234, member A
  Uniprot ID: Q9H0X4
  ENSP ID: ENSP00000301678
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 30180 - protein, 540 aa, Homo sapiens
  Payload ID: 5908
  Gene Symbol: FAM234A
  Gene Name: family with sequence similarity 234, member A
  Uniprot ID: Q9H0X4
  ENSP ID: ENSP00000301679
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKAHTGRQRRGSWTGQSSRRDLHVRVL

SEQ ID NO: 30181 - protein, 552 aa, Homo sapiens; identical to SEQ ID NO: 30179
  Payload ID: 5908
  Gene Symbol: FAM234A
  Gene Name: family with sequence similarity 234, member A
  Uniprot ID: Q9H0X4
  ENSP ID: ENSP00000382814

SEQ ID NO: 30182 - protein, 102 aa, Homo sapiens
  Payload ID: 5908
  Gene Symbol: FAM234A
  Gene Name: family with sequence similarity 234, member A
  ENSP ID: ENSP00000388726
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDING

SEQ ID NO: 30183 - protein, 50 aa, Homo sapiens
  Payload ID: 5908
  Gene Symbol: FAM234A
  Gene Name: family with sequence similarity 234, member A
  ENSP ID: ENSP00000392612
MLDHKDLEAEIHPLKNEERKSQENLGNPSKNEDNVKSAPPQSRLSRCRAA

SEQ ID NO: 30184 - protein, 87 aa, Homo sapiens
  Payload ID: 5908
  Gene Symbol: FAM234A
  Gene Name: family with sequence similarity 234, member A
  ENSP ID: ENSP00000395334
MLDHKDLEAEIHPLKNEERKSQENLGNPSKNEDNVKSAPPQSRLSRCRAAAFFLSLFLCLFVVFVVSFVIPCPDRPASQRMWRIDYS

SEQ ID NO: 30185 - protein, 233 aa, Homo sapiens
  Payload ID: 5908
  Gene Symbol: FAM234A
  Gene Name: family with sequence similarity 234, member A
  ENSP ID: ENSP00000398433
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQE

SEQ ID NO: 30186 - protein, 236 aa, Homo sapiens
  Payload ID: 5908
  Gene Symbol: FAM234A
  Gene Name: family with sequence similarity 234, member A
  ENSP ID: ENSP00000399150
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREE

SEQ ID NO: 30187 - protein, 131 aa, Homo sapiens
  Payload ID: 5908
  Gene Symbol: FAM234A
  Gene Name: family with sequence similarity 234, member A
  ENSP ID: ENSP00000402119
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEAAV

SEQ ID NO: 30188 - protein, 68 aa, Homo sapiens
  Payload ID: 5908
  Gene Symbol: FAM234A
  Gene Name: family with sequence similarity 234, member A
  ENSP ID: ENSP00000405659
MLDHKDLEAEIHPLKNEERKSQENLGNPSKNEDNVKSAPPQSRLSRCRAAAFFLSLFLCLFVVFVVSF

SEQ ID NO: 30189 - protein, 242 aa, Homo sapiens
  Payload ID: 5908
  Gene Symbol: FAM234A
  Gene Name: family with sequence similarity 234, member A
  ENSP ID: ENSP00000407669
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIG

SEQ ID NO: 30190 - protein, 192 aa, Homo sapiens
  Payload ID: 5908
  Gene Symbol: FAM234A
  Gene Name: family with sequence similarity 234, member A
  ENSP ID: ENSP00000407875
  MOD_RES (1)..(1): Any amino acid
XESMLNATTRRMLSHSSGAVRYLMHVPGNAGADVLLVGSEAFVLLDGQELTPRWTPKAAHVLRKPIFGRYKPDTLAVAVENGTGTDRQETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 30191 - protein, 103 aa, Homo sapiens
  Payload ID: 5908
  Gene Symbol: FAM234A
  Gene Name: family with sequence similarity 234, member A
  ENSP ID: ENSP00000409309
MLDHKDLEAEIHPLKNEERKSQENLGNPSKNEDNVKSAPPQSRLSRCRAAAFFLSLFLCLFVVFVVSFVIPCPDRPASQRMWRIDYSAAGFSSPCTFAAAVSG

SEQ ID NO: 30192 - protein, 234 aa, Homo sapiens
  Payload ID: 5908
  Gene Symbol: FAM234A
  Gene Name: family with sequence similarity 234, member A
  ENSP ID: ENSP00000412581
  MOD_RES (1)..(1): Any amino acid
XPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGAVRCHLPWGSREEERLGPRLLLGCQWWQCPGRAQNMNQHSARQGRSGPVSAPKPEGAGLRAPAEPASWKDEGKNAWCTGPCVCVGSLHLIAVWKISVPRFGECSYFPYKLSF

SEQ ID NO: 30193 - protein, 622 aa, Homo sapiens
  Payload ID: 5909
  Gene Symbol: FAM234B
  Gene Name: family with sequence similarity 234, member B
  Uniprot ID: A2RU67
  ENSP ID: ENSP00000197268
MATVLSRALKLPGKKSPDLGEYDPLTQADSDESEDDLVLNLQKNGGVKNGKSPLGEAPEPDSDAEVAEAAKPHLSEVTTEGYPSEPLGGLEQKAASSLVSYVRTSVFLLTLGISMILVLLCAFLIPCPPRDLHSTWSRHLGSQGGGDLSPLELADVNGDGLRDVLLSFVMSRNGSAVGVSRPAANLVCLSGMNGSTLWSSLLPEEARDITCLELMPGSLAETICLVTGTHKMLSAFNATSGKAIWTLNPNYLSNGTLAAPVVVLPDLDEDGVRDLVVLAIGELQPDLCFLLVSGRTGNPVGRPVKYNIVGVGNLIGPQVYITTNGAVYILFGFGNIQAVALRDIFVQAQNRDSSPPSLQIEEPEWEKRRSINLSELIDVYSDGVELLQMVKAPDSNCSNLLITTRQSLVLLRGQNLTPYWALRLQGLRSQPTPGYFTDDQTLDFLLQIQDGVGMKKMMVVDGDSGSIVWSYRAPCHMKETPATSAVTSDQKSVFLFWAEGLSAASPNSDIILGTEPPSLHHLYLLHPAFPSILLDLANTTGTVTASEVGINDLWKDAFYVTRTTGPSSEGHPAALVVSKLSLRWALMEGQMAQLQESTPKIGRGELRRFLSRIKFVEAPYEI

SEQ ID NO: 30194 - protein, 622 aa, Homo sapiens; identical to SEQ ID NO: 30193
  Payload ID: 5909
  Gene Symbol: FAM234B
  Gene Name: family with sequence similarity 234, member B
  Uniprot ID: A2RU67
  ENSP ID: ENSP00000394063

SEQ ID NO: 30195 - protein, 324 aa, Homo sapiens
  Payload ID: 5909
  Gene Symbol: FAM234B
  Gene Name: family with sequence similarity 234, member B
  ENSP ID: ENSP00000437974
LVTGTHKMLSAFNATSGKAIWTLNPNYLSNGTLAAPVVVLPDLDEDGVRDLVVLAIGELQPDLCFLLVSGRTGNPVGRPVKYNIVGVGNLIGPQVYITTNGAVYILFGFGNIQAVALRDIFVQAQNRDSSPPSLQIEEPEWEKRRSINLSELIDVYSDGVELLQMVKAPDSNCSNLLITTRQSLVLLRGQNLTPYWALRLQGLRSQPTPGYFTDDQTLDFLLQIQDGVGMKKMMVVDGDSGSIVWSYRAPCHMKETPATSAVTSDQKSVFLFWAEGLSAASPNSDIILGTEPPSLHHLYLLHPAFPSILLDLANTTGTVTASEG

SEQ ID NO: 30196 - protein, 105 aa, Homo sapiens
  Payload ID: 5910
  Gene Symbol: FAM24A
  Gene Name: family with sequence similarity 24, member A
  Uniprot ID: A6NFZ4
  ENSP ID: ENSP00000357889
MAKMFDLRTKIMIGIGSSLLVAAMVLLSVVFCLYFKVAKALKAAKDPDAVAVKNHNPDKVCWATNSQAKATTMESCPSLQCCEGCRMHASSDSLPPCCCDINEGL

SEQ ID NO: 30197 - protein, 94 aa, Homo sapiens
  Payload ID: 5911
  Gene Symbol: FAM24B
  Gene Name: family with sequence similarity 24, member B
  Uniprot ID: Q8N5W8
  ENSP ID: ENSP00000357892
MPVIAGGILAALLLLIVVVLCLYFKIHNALKAAKEPEAVAVKNHNPDKVWWAKNSQAKTIATESCPALQCCEGYRMCASFDSLPPCCCDINEGL

SEQ ID NO: 30198 - protein, 94 aa, Homo sapiens; identical to SEQ ID NO: 30197
  Payload ID: 5911
  Gene Symbol: FAM24B
  Gene Name: family with sequence similarity 24, member B
  Uniprot ID: Q8N5W8
  ENSP ID: ENSP00000357894

SEQ ID NO: 30199 - protein, 89 aa, Homo sapiens
  Payload ID: 5912
  Gene Symbol: FAM25A
  Gene Name: family with sequence similarity 25, member A
  Uniprot ID: B3EWG3
  ENSP ID: ENSP00000342790
MLGGLGKLAAEGLAHRTEKATEGAIHAVEEVVKEVVGHAKETGEKAIAEAIKKAQESGDKKMKEITETVTNTVTNAITHAAESLDKLGQ

SEQ ID NO: 30200 - protein, 89 aa, Homo sapiens; identical to SEQ ID NO: 30199
  Payload ID: 5913
  Gene Symbol: FAM25C
  Gene Name: family with sequence similarity 25, member C
  Uniprot ID: B3EWG5
  ENSP ID: ENSP00000485370

SEQ ID NO: 30201 - protein, 89 aa, Homo sapiens; identical to SEQ ID NO: 30199
  Payload ID: 5914
  Gene Symbol: FAM25G
  Gene Name: family with sequence similarity 25, member G
  Uniprot ID: B3EWG6
  ENSP ID: ENSP00000413896

SEQ ID NO: 30202 - protein, 314 aa, Homo sapiens
  Payload ID: 5915
  Gene Symbol: FAM26D
  Gene Name: family with sequence similarity 26, member D
  Uniprot ID: Q5JW98
  ENSP ID: ENSP00000357585
MCPTLNNIVSSLQRNGIFINSLIAALTIGGQQLFSSSTFSCPCQVGKNFYYGSAFLVIPALILLVAGFALRSQMWTITGEYCCSCAPPYRRISPLECKLACLRFFSITGRAVIAPLTWLAVTLLTGTYYECAASEFASVDHYPMFDNVSASKREEILAGFPCCRSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 30203 - protein, 128 aa, Homo sapiens
  Payload ID: 5915
  Gene Symbol: FAM26D
  Gene Name: family with sequence similarity 26, member D
  Uniprot ID: Q5JW98
  ENSP ID: ENSP00000357586
MLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 30204 - protein, 171 aa, Homo sapiens
  Payload ID: 5915
  Gene Symbol: FAM26D
  Gene Name: family with sequence similarity 26, member D
  Uniprot ID: Q5JW98
  ENSP ID: ENSP00000385836
MFDNVSASKREEILAGFPCCRSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 30205 - protein, 123 aa, Homo sapiens
  Payload ID: 5915
  Gene Symbol: FAM26D
  Gene Name: family with sequence similarity 26, member D
  ENSP ID: ENSP00000409556
MLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRG

SEQ ID NO: 30206 - protein, 170 aa, Homo sapiens
  Payload ID: 5915
  Gene Symbol: FAM26D
  Gene Name: family with sequence similarity 26, member D
  Uniprot ID: Q5JW98
  ENSP ID: ENSP00000487169
MAPRSAKETFRINPNVAANLSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 30207 - protein, 309 aa, Homo sapiens
  Payload ID: 5916
  Gene Symbol: FAM26E
  Gene Name: family with sequence similarity 26, member E
  Uniprot ID: Q8N5C1
  ENSP ID: ENSP00000357588
MDAFQGILKFFLNQKTVIGYSFMALLTVGSERLFSVVAFKCPCSTENMTYGLVFLFAPAWVLLILGFFLNNRSWRLFTGCCVNPRKIFPRGHSCRFFYVLGQITLSSLVAPVMWLSVALLNGTFYECAMSGTRSSGLLELICKGKPKECWEELHKVSCGKTSMLPTVNEELKLSLQAQSQILGWCLICSASFFSLLTTCYARCRSKVSYLQLSFWKTYAQKEKEQLENTFLDYANKLSERNLKCFFENKRPDPFPMPTFAAWEAASELHSFHQSQQHYSTLHRVVDNGLQLSPEDDETTMVLVGTAHNM

SEQ ID NO: 30208 - protein, 158 aa, Homo sapiens
  Payload ID: 5917
  Gene Symbol: FAM26F
  Gene Name: family with sequence similarity 26, member F
  ENSP ID: ENSP00000357593
RWGRLGGAERPSFLRAAGVLGWILIAVVIIILLIFTSVTRCLSPVSFLQLKFWKIYLEQEQQILKSKATEHATELAKENIKCFFEGSHPKEYNTPSMKEWQQISSLYTFNPKGQYYSMLHKYVNRKEKTHSIRSTEGDTVIPVLGFVDSSGINSTPEL

SEQ ID NO: 30209 - protein, 315 aa, Homo sapiens
  Payload ID: 5917
  Gene Symbol: FAM26F
  Gene Name: family with sequence similarity 26, member F
  Uniprot ID: Q5R3K3
  ENSP ID: ENSP00000357594
MEKFRAVLDLHVKHHSALGYGLVTLLTAGGERIFSAVAFQCPCSAAWNLPYGLVFLLVPALALFLLGYVLSARTWRLLTGCCSSARASCGSALRGSLVCTQISAAAALAPLTWVAVALLGGAFYECAATGSAAFAQRLCLGRNRSCAAELPLVPCNQAKASDVQDLLKDLKAQSQVLGWILIAVVIIILLIFTSVTRCLSPVSFLQLKFWKIYLEQEQQILKSKATEHATELAKENIKCFFEGSHPKEYNTPSMKEWQQISSLYTFNPKGQYYSMLHKYVNRKEKTHSIRSTEGDTVIPVLGFVDSSGINSTPEL

SEQ ID NO: 30210 - protein, 143 aa, Homo sapiens
  Payload ID: 5917
  Gene Symbol: FAM26F
  Gene Name: family with sequence similarity 26, member F
  Uniprot ID: Q5R3K3
  ENSP ID: ENSP00000357595
MFPVLGWILIAVVIIILLIFTSVTRCLSPVSFLQLKFWKIYLEQEQQILKSKATEHATELAKENIKCFFEGSHPKEYNTPSMKEWQQISSLYTFNPKGQYYSMLHKYVNRKEKTHSIRSTEGDTVIPVLGFVDSSGINSTPEL

SEQ ID NO: 30211 - protein, 244 aa, Homo sapiens
  Payload ID: 5918
  Gene Symbol: FAM3A
  Gene Name: family with sequence similarity 3, member A
  ENSP ID: ENSP00000320521
MDRGQHPPGWAWQWLSSHPATLHQLECSGAISVHCNLYLLGSSDSSAPASRVAETTGPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 30212 - protein, 230 aa, Homo sapiens
  Payload ID: 5918
  Gene Symbol: FAM3A
  Gene Name: family with sequence similarity 3, member A
  Uniprot ID: P98173
  ENSP ID: ENSP00000352955
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 30213 - protein, 237 aa, Homo sapiens
  Payload ID: 5918
  Gene Symbol: FAM3A
  Gene Name: family with sequence similarity 3, member A
  ENSP ID: ENSP00000358655
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGPLPPDTGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 30214 - protein, 230 aa, Homo sapiens; identical to SEQ ID NO: 30212
  Payload ID: 5918
  Gene Symbol: FAM3A
  Gene Name: family with sequence similarity 3, member A
  Uniprot ID: P98173
  ENSP ID: ENSP00000358657

SEQ ID NO: 30215 - protein, 192 aa, Homo sapiens
  Payload ID: 5918
  Gene Symbol: FAM3A
  Gene Name: family with sequence similarity 3, member A
  Uniprot ID: P98173
  ENSP ID: ENSP00000377202
MRLAGPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 30216 - protein, 70 aa, Homo sapiens
  Payload ID: 5918
  Gene Symbol: FAM3A
  Gene Name: family with sequence similarity 3, member A
  ENSP ID: ENSP00000392624
MRLAGPLRIVVLVVSVGVTWIVVSILLGGPGSGFPRIQQLFTMSHFVSQAGVQWCNLGSLQPLPPGFKRF

SEQ ID NO: 30217 - protein, 213 aa, Homo sapiens
  Payload ID: 5918
  Gene Symbol: FAM3A
  Gene Name: family with sequence similarity 3, member A
  Uniprot ID: P98173
  ENSP ID: ENSP00000393086
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 30218 - protein, 70 aa, Homo sapiens
  Payload ID: 5918
  Gene Symbol: FAM3A
  Gene Name: family with sequence similarity 3, member A
  ENSP ID: ENSP00000396243
MRLAGPLRIVVLVVSVGVTWIVVSILLGGPGSGFPRIQQLFTSWSAVVQSRFTATSTSWVQAILVPQPPE

SEQ ID NO: 30219 - protein, 163 aa, Homo sapiens
  Payload ID: 5918
  Gene Symbol: FAM3A
  Gene Name: family with sequence similarity 3, member A
  ENSP ID: ENSP00000396845
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGPLPPDTGVSGELIEARAFDMWAGDVNDLLKFIRPLHEGTLVFVASYDDPAT

SEQ ID NO: 30220 - protein, 39 aa, Homo sapiens
  Payload ID: 5918
  Gene Symbol: FAM3A
  Gene Name: family with sequence similarity 3, member A
  ENSP ID: ENSP00000397396
MRLAGPESSVTAVTENPSVLGPCGLTSRTQSMEVSPASA

SEQ ID NO: 30221 - protein, 51 aa, Homo sapiens
  Payload ID: 5918
  Gene Symbol: FAM3A
  Gene Name: family with sequence similarity 3, member A
  ENSP ID: ENSP00000401367
MRLAGPLRIVVLVVSVGVTWIVVSILLGGPGSGFPRIQQLFTSPESSVTAG

SEQ ID NO: 30222 - protein, 70 aa, Homo sapiens; identical to SEQ ID NO: 30218
  Payload ID: 5918
  Gene Symbol: FAM3A
  Gene Name: family with sequence similarity 3, member A
  ENSP ID: ENSP00000404171

SEQ ID NO: 30223 - protein, 70 aa, Homo sapiens; identical to SEQ ID NO: 30218
  Payload ID: 5918
  Gene Symbol: FAM3A
  Gene Name: family with sequence similarity 3, member A
  ENSP ID: ENSP00000406340

SEQ ID NO: 30224 - protein, 53 aa, Homo sapiens
  Payload ID: 5918
  Gene Symbol: FAM3A
  Gene Name: family with sequence similarity 3, member A
  ENSP ID: ENSP00000407870
MRLAGPLRIVVLVVSVGVTWIVVSILLGGPGSGFPRIQQLFTSPESSVTADLR

SEQ ID NO: 30225 - protein, 21 aa, Homo sapiens
  Payload ID: 5918
  Gene Symbol: FAM3A
  Gene Name: family with sequence similarity 3, member A
  ENSP ID: ENSP00000408973
MRLAGPESSVTAAPRARKYKC

SEQ ID NO: 30226 - protein, 77 aa, Homo sapiens
  Payload ID: 5918
  Gene Symbol: FAM3A
  Gene Name: family with sequence similarity 3, member A
  ENSP ID: ENSP00000415843
MRLAGPLRIVVLVVSVGVTWIVVSILLGGPGSGFPRIQQLFTSPESSVTAVTENPSVLGPCGLTSRTQSMEVSPASA

SEQ ID NO: 30227 - protein, 230 aa, Homo sapiens; identical to SEQ ID NO: 30212
  Payload ID: 5918
  Gene Symbol: FAM3A
  Gene Name: family with sequence similarity 3, member A
  Uniprot ID: P98173
  ENSP ID: ENSP00000416146

SEQ ID NO: 30228 - protein, 70 aa, Homo sapiens; identical to SEQ ID NO: 30218
  Payload ID: 5918
  Gene Symbol: FAM3A
  Gene Name: family with sequence similarity 3, member A
  ENSP ID: ENSP00000478650

SEQ ID NO: 30229 - protein, 235 aa, Homo sapiens
  Payload ID: 5919
  Gene Symbol: FAM3B
  Gene Name: family with sequence similarity 3, member B
  Uniprot ID: P58499
  ENSP ID: ENSP00000350673
MRPLAGGLLKVVFVVFASLCAWYSGYLLAELIPDAPLSSAAYSIRSIGERPVLKAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 30230 - protein, 258 aa, Homo sapiens
  Payload ID: 5919
  Gene Symbol: FAM3B
  Gene Name: family with sequence similarity 3, member B
  ENSP ID: ENSP00000381641
MKSHRGDGEGQGPGPPPSRSQQLLGVLSAGLLKVVFVVFASLCAWYSGYLLAELIPDAPLSSAAYSIRSIGERPVLKAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 30231 - protein, 187 aa, Homo sapiens
  Payload ID: 5919
  Gene Symbol: FAM3B
  Gene Name: family with sequence similarity 3, member B
  Uniprot ID: P58499
  ENSP ID: ENSP00000381642
MRPLAGAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 30232 - protein, 274 aa, Homo sapiens
  Payload ID: 5919
  Gene Symbol: FAM3B
  Gene Name: family with sequence similarity 3, member B
  Uniprot ID: P58499
  ENSP ID: ENSP00000381646
MRPLAGGSRWACWLTRCLISCFDINVQGRLLVKLRPKPTANTTCPGLLKVVFVVFASLCAWYSGYLLAELIPDAPLSSAAYSIRSIGERPVLKAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 30233 - protein, 227 aa, Homo sapiens
  Payload ID: 5920
  Gene Symbol: FAM3C
  Gene Name: family with sequence similarity 3, member C
  Uniprot ID: Q92520
  ENSP ID: ENSP00000353025
MRVAGAAKLVVAVAVFLLTFYVISQVFEIKMDASLGNLFARSALDTAARSTKPPRYKCGISKACPEKHFAFKMASGAANVVGPKICLEDNVLMSGVKNNVGRGINVALANGKTGEVLDTKYFDMWGGDVAPFIEFLKAIQDGTIVLMGTYDDGATKLNDEARRLIADLGSTSITNLGFRDNWVFCGGKGIKTKSPFEQHIKNNKDTNKYEGWPEVVEMEGCIPQKQD

SEQ ID NO: 30234 - protein, 151 aa, Homo sapiens
  Payload ID: 5920
  Gene Symbol: FAM3C
  Gene Name: family with sequence similarity 3, member C
  ENSP ID: ENSP00000408636
MRVAGAAKLVVAVAVFLLTFYVISQVFEIKMDASLGNLFARSALDTAARSTKPPRYKCGISKACPEKHFAFKMASGAANVVGPKICLEDNVLMSGVKNNVGRGINVALANGKTGEVLDTKYFDMWGGDVAPFIEFLKAIQDGTIVLMGTYD

SEQ ID NO: 30235 - protein, 109 aa, Homo sapiens
  Payload ID: 5920
  Gene Symbol: FAM3C
  Gene Name: family with sequence similarity 3, member C
  ENSP ID: ENSP00000414940
MDASLGNLFARSALDTAARSTKPPRYKCGISKACPEKHFAFKMASGAANVVGPKICLEDNVLMSGVKNNVGRGINVALANGKTGEVLDTKYFDMWGGDVAPFIEFLKAI

SEQ ID NO: 30236 - protein, 224 aa, Homo sapiens
  Payload ID: 5921
  Gene Symbol: FAM3D
  Gene Name: family with sequence similarity 3, member D
  Uniprot ID: Q96BQ1
  ENSP ID: ENSP00000351632
MRVSGVLRLLALIFAIVTTWMFIRSYMSFSMKTIRLPRWLAASPTKEIQVKKYKCGLIKPCPANYFAFKICSGAANVVGPTMCFEDRMIMSPVKNNVGRGLNIALVNGTTGAVLGQKAFDMYSGDVMHLVKFLKEIPGGALVLVASYDDPGTKMNDESRKLFSDLGSSYAKQLGFRDSWVFIGAKDLRGKSPFEQFLKNSPDTNKYEGWPELLEMEGCMPPKPF

SEQ ID NO: 30237 - protein, 151 aa, Homo sapiens
  Payload ID: 5921
  Gene Symbol: FAM3D
  Gene Name: family with sequence similarity 3, member D
  ENSP ID: ENSP00000417099
MRVSGVLRLLALIFAIVTTWMFIRSYMSFSMKTIRLPRWLASPTKEIQVKKYKCGLIKPCPANYFAFKICSGAANVVGPTMCFEDRMIMSPVKNNVGRGLNIALVNGTTGAVLGQKAFDMYSGDVMHLVKFLKEIPGGALVLVASYDDPGT

SEQ ID NO: 30238 - protein, 112 aa, Homo sapiens
  Payload ID: 5921
  Gene Symbol: FAM3D
  Gene Name: family with sequence similarity 3, member D
  ENSP ID: ENSP00000417453
MRVSASPTKEIQVKKYKCGLIKPCPANYFAFKICSGAANVVGPTMCFEDRMIMSPVKNNVGRGLNIALVNGTTGAVLGQKAFDMYSGDVMHLVKFLKEIPGGALVLVASYDD

SEQ ID NO: 30239 - protein, 39 aa, Homo sapiens
  Payload ID: 5921
  Gene Symbol: FAM3D
  Gene Name: family with sequence similarity 3, member D
  ENSP ID: ENSP00000418414
MRVSAPSPQPPSCRRVRSAFPLTRFCLLSSSLAHQGDPG

SEQ ID NO: 30240 - protein, 102 aa, Homo sapiens
  Payload ID: 5921
  Gene Symbol: FAM3D
  Gene Name: family with sequence similarity 3, member D
  ENSP ID: ENSP00000418982
MRVSGVLRLLALIFAIVTTWMFIRSYMSFSMKTIRLPRWLAASPTKEIQVKKYKCGLIKPCPANYFAFKICSGAANVVGPTMCFEDRMIMSPVKNNVGRGLN

SEQ ID NO: 30241 - protein, 112 aa, Homo sapiens
  Payload ID: 5922
  Gene Symbol: FAM32A
  Gene Name: family with sequence similarity 32, member A
  Uniprot ID: Q9Y421
  ENSP ID: ENSP00000263384
MEAYEQVQKGPLKLKGVAELGVTKRKKKKKDKDKAKLLEAMGTSKKNEEEKRRGLDKRTPAQAAFEKMQEKRQMERILKKASKTHKQRVEDFNRHLDTLTEHYDIPKVSWTK

SEQ ID NO: 30242 - protein, 94 aa, Homo sapiens
  Payload ID: 5922
  Gene Symbol: FAM32A
  Gene Name: family with sequence similarity 32, member A
  ENSP ID: ENSP00000464939
MEAYEQVQKGPLKLKGVAELGVTKRKKKKKDKDKAKLLEAMGTSKKNEEEKRRGLDKRTPAQAAFEKMQEKRDFNRHLDTLTEHYDIPKVSWTK

SEQ ID NO: 30243 - protein, 92 aa, Homo sapiens
  Payload ID: 5922
  Gene Symbol: FAM32A
  Gene Name: family with sequence similarity 32, member A
  Uniprot ID: Q9Y421
  ENSP ID: ENSP00000465969
MSFSRKKKKKDKDKAKLLEAMGTSKKNEEEKRRGLDKRTPAQAAFEKMQEKRQMERILKKASKTHKQRVEDFNRHLDTLTEHYDIPKVSWTK

SEQ ID NO: 30244 - protein, 82 aa, Homo sapiens
  Payload ID: 5922
  Gene Symbol: FAM32A
  Gene Name: family with sequence similarity 32, member A
  ENSP ID: ENSP00000466294
EQVQKGPLKLKGVAELGVTKRKKKKKDKDKAKLLEAMGTSKKNEEEKRRGLDKRTPAQAAFEKMQEKRRCGFTMLARLISNF

SEQ ID NO: 30245 - protein, 107 aa, Homo sapiens
  Payload ID: 5922
  Gene Symbol: FAM32A
  Gene Name: family with sequence similarity 32, member A
  ENSP ID: ENSP00000467027
MEAYEQVQKGPLKLKGVAELGVTKRKKKKKDKDKAKLLEAMGTSKKNEEEKRRGLDKRTPAQAAFEKMQEKRQGHQTSCTATGFQGHKANAARSYAWTQNWYCVPSS

SEQ ID NO: 30246 - protein, 835 aa, Homo sapiens
  Payload ID: 5923
  Gene Symbol: FAM35A
  Gene Name: family with sequence similarity 35, member A
  Uniprot ID: Q86V20
  ENSP ID: ENSP00000298784
MSGGSQVHIFWGAPIAPLKITVSEDTASLMSVADPWKKIQLLYSQHSLYLKDEKQHKNLENYKVPESIGSPDLSGHFLANCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 30247 - protein, 904 aa, Homo sapiens
  Payload ID: 5923
  Gene Symbol: FAM35A
  Gene Name: family with sequence similarity 35, member A
  Uniprot ID: Q86V20
  ENSP ID: ENSP00000298786
MSGGSQVHIFWGAPIAPLKITVSEDTASLMSVADPWKKIQLLYSQHSLYLKDEKQHKNLENYKVPESIGSPDLSGHFLANCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGYIWEFKYLFVQCNYTLENLELHTTPWSSCECLFDDDIRAITFKAKFQKSAPSFVKISDLATHLEDKCSGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 30248 - protein, 93 aa, Homo sapiens
  Payload ID: 5923
  Gene Symbol: FAM35A
  Gene Name: family with sequence similarity 35, member A
  ENSP ID: ENSP00000475647
MSGGSQVHIFWGAPIAPLKITVSEDTASLMSVADPWKKIQLLYSQHSLYLKDEKQHKNLENYKVPESIGSPDLSGHFLANCMNRHVHVKDDFV

SEQ ID NO: 30249 - protein, 423 aa, Homo sapiens
  Payload ID: 5924
  Gene Symbol: FAM43A
  Gene Name: family with sequence similarity 43, member A
  Uniprot ID: Q8N2R8
  ENSP ID: ENSP00000371397
MLPWKKHKFELLAEAPPRQASKPKGYAVSLHYSALSSLARACPEGALSRVGSMFRSKRKKLHITSEDPTYTVLYLGNATTIQARGDGCTDLAVGKIWSKSEAGRQGTKMKLTVSAQGIRMVHAEERALRRPGHLYLLHRVTYCVADARLPKVFAWVYRHELKHKAVMLRCHAVLVSKPEKAQAMALLLYQTSANALAEFKRLKRRDDARHQQQELVGAHTIPLVPLRKLLLHGPCCYKPPVERSRSAPKLGSITEDLLGEQLEQELQEEEEEEQPEGCPEEEENRAAEGDPAEEEAEAQRALVVAMHFECGDLLDTLENGRGEALGGGGGSLGPGAGPPPLLLGSASDMKAELSQLISDLGELSFGNDVRTLQADLRVTRLLSGDSTGSESSIEGGGPDATSATAGDSSRQADGASADEPHSG

SEQ ID NO: 30250 - protein, 329 aa, Homo sapiens
  Payload ID: 5925
  Gene Symbol: FAM43B
  Gene Name: family with sequence similarity 43, member B
  Uniprot ID: Q6ZT52
  ENSP ID: ENSP00000331397
MLPWRRNKFVLVEDEAKCKAKSLSPGLAYTSLLSSFLRSCPDLLPDWPLERLGRVFRSRRQKVELNKEDPTYTVWYLGNAVTLHAKGDGCTDDAVGKIWARCGPGGGTKMKLTLGPHGIRMQPCERSAAGGSGGRRPAHAYLLPRITYCTADGRHPRVFAWVYRHQARHKAVVLRCHAVLLARAHKARALARLLRQTALAAFSDFKRLQRQSDARHVRQQHLRAGGAAASVPRAPLRRLLNAKCAYRPPPSERSRGAPRLSSIQEEDEEEEEDDAEEQEGGVPQRERPEVLSLARELRTCSLRGAPAPPPPAQPRRWKAGPRERAGQAR

SEQ ID NO: 30251 - protein, 357 aa, Homo sapiens
  Payload ID: 5926
  Gene Symbol: FAM45A
  Gene Name: family with sequence similarity 45, member A
  Uniprot ID: Q8TCE6
  ENSP ID: ENSP00000354688
MAAAEVADTQLMLGVGLIEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDARKAYLAGSIKDIVSQFGMETVILHTALMLKKRIVVYHPKIEAVQEFTRTLPALVWHRQDWTILHSYVHLNADELEALQMCTGYVAGFVDLEVSNRPDLYDVFVNLAESEITIAPLAKEAMAMGKLHKEMGQLIVQSAEDPEKSESHVIQDIALKTREIFTNLAPFSEVSADGEKRVLNLEALKQKRFPPATENFLYHLAAAEQMLKI

SEQ ID NO: 30252 - protein, 221 aa, Homo sapiens
  Payload ID: 5926
  Gene Symbol: FAM45A
  Gene Name: family with sequence similarity 45, member A
  ENSP ID: ENSP00000444309
MAAAEVADTQLMLGVGLIEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDARKAYLAGSIKDIVSQFGMNCYLTHSTDAKEKNCGVSPQDRSGPGVHQDSACPGVAPTGLDHPSLLRAPQRR

SEQ ID NO: 30253 - protein, 442 aa, Homo sapiens
  Payload ID: 5927
  Gene Symbol: FAM46A
  Gene Name: family with sequence similarity 46, member A
  Uniprot ID: Q96IP4
  ENSP ID: ENSP00000318298
MAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 30254 - protein, 461 aa, Homo sapiens
  Payload ID: 5927
  Gene Symbol: FAM46A
  Gene Name: family with sequence similarity 46, member A
  Uniprot ID: Q96IP4
  ENSP ID: ENSP00000358769
MHQRYFWTDQGQVALGGHYMAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 30255 - protein, 523 aa, Homo sapiens
  Payload ID: 5927
  Gene Symbol: FAM46A
  Gene Name: family with sequence similarity 46, member A
  ENSP ID: ENSP00000358771
MQMRRVWRTCRSGPRKRREARYKKSTEDIFPAQLLKLQRHERVWQQEPPVRDHRSWGGSGAGGVAGREWTDQGQVALGGHYMAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 30256 - protein, 88 aa, Homo sapiens
  Payload ID: 5927
  Gene Symbol: FAM46A
  Gene Name: family with sequence similarity 46, member A
  ENSP ID: ENSP00000401884
  MOD_RES (1)..(1): Any amino acid
XKRIGVRDVRLNGSAASHVLHQDSGLGYKDLDLIFCADLRGEGEFQTVKDVVLDCLLDFLPEGVNKEKITPLTLKEESHTTTYFLNIS

SEQ ID NO: 30257 - protein, 86 aa, Homo sapiens
  Payload ID: 5927
  Gene Symbol: FAM46A
  Gene Name: family with sequence similarity 46, member A
  ENSP ID: ENSP00000404872
  MOD_RES (1)..(1): Any amino acid
XQDSGLGYKDLDLIFCADLRGEGEFQTVKDVVLDCLLDFLPEGVNKEKITPLTLKVFHRLLRHWRAAEKTGVLFAEPLCGIGRPQV

SEQ ID NO: 30258 - protein, 425 aa, Homo sapiens
  Payload ID: 5928
  Gene Symbol: FAM46B
  Gene Name: family with sequence similarity 46, member B
  Uniprot ID: Q96A09
  ENSP ID: ENSP00000289166
MMPSESGAERRDRAAAQVGTAAATAVATAAPAGGGPDPEALSAFPGRHLSGLSWPQVKRLDALLSEPIPIHGRGNFPTLSVQPRQIVQVVRSTLEEQGLHVHSVRLHGSAASHVLHPESGLGYKDLDLVFRVDLRSEASFQLTKAVVLACLLDFLPAGVSRAKITPLTLKEAYVQKLVKVCTDSDRWSLISLSNKSGKNVELKFVDSVRRQFEFSIDSFQIILDSLLLFGQCSSTPMSEAFHPTVTGESLYGDFTEALEHLRHRVIATRSPEEIRGGGLLKYCHLLVRGFRPRPSTDVRALQRYMCSRFFIDFPDLVEQRRTLERYLEAHFGGADAARRYACLVTLHRVVNESTVCLMNHERRQTLDLIAALALQALAEQGPAATAALAWRPPGTDGVVPATVNYYVTPVQPLLAHAYPTWLPCN

SEQ ID NO: 30259 - protein, 391 aa, Homo sapiens
  Payload ID: 5929
  Gene Symbol: FAM46C
  Gene Name: family with sequence similarity 46, member C
  Uniprot ID: Q5VWP2
  ENSP ID: ENSP00000358458
MAEESSCTRDCMSFSVLNWDQVSRLHEVLTEVVPIHGRGNFPTLEITLKDIVQTVRSRLEEAGIKVHDVRLNGSAAGHVLVKDNGLGCKDLDLIFHVALPTEAEFQLVRDVVLCSLLNFLPEGVNKLKISPVTLKEAYVQKLVKVCTDTDRWSLISLSNKNGKNVELKFVDSIRRQFEFSVDSFQIILDSLLFFYDCSNNPISEHFHPTVIGESMYGDFEEAFDHLQNRLIATKNPEEIRGGGLLKYSNLLVRDFRPTDQEEIKTLERYMCSRFFIDFPDILEQQRKLETYLQNHFAEEERSKYDYLMILRRVVNESTVCLMGHERRQTLNLISLLALRVLAEQNIIPSATNVTCYYQPAPYVSDGNFSNYYVAHPPVTYSQPYPTWLPCN

SEQ ID NO: 30260 - protein, 389 aa, Homo sapiens
  Payload ID: 5930
  Gene Symbol: FAM46D
  Gene Name: family with sequence similarity 46, member D
  Uniprot ID: Q8NEK8
  ENSP ID: ENSP00000308575
MSEIRFTNLTWDQVITLDQVLDEVIPIHGKGNFPTMEVKPKDIIHVVKDQLIGQGIIVKDARLNGSVASYILASHNGISYKDLDVIFGVELPGNEEFQVVKDAVLDCLLDFLPKDVKKEKLSPDIMKDAYVQKLVKVCNGHDCWSLISLSNNTGKNLELKFVSSLRRQFEFSVDSFQIVLDPMLDFYSDKNAKLTKESYPVVVAESMYGDFQEAMTHLQHKLICTRKPEEIRGGGLLKYCSLLVHGFKPACMSEIKNLERYMCSRFFIDFPHIEEQQKKIESYLHNHFIGEGMTKYDYLMTLHGVVNESTVCLMSYERRQILHLITMMALKVLGELNILPNTQKVTCFYQPAPYFAAEARYPIYVIPEPPPVSFQPYHPLHFRGSNGMS

SEQ ID NO: 30261 - protein, 389 aa, Homo sapiens; identical to SEQ ID NO: 30260
  Payload ID: 5930
  Gene Symbol: FAM46D
  Gene Name: family with sequence similarity 46, member D
  Uniprot ID: Q8NEK8
  ENSP ID: ENSP00000443410

SEQ ID NO: 30262 - protein, 791 aa, Homo sapiens
  Payload ID: 5931
  Gene Symbol: FAM47A
  Gene Name: family with sequence similarity 47, member A
  Uniprot ID: Q5JRC9
  ENSP ID: ENSP00000345029
MGDQRLQDWLRSPGMDSKPWYCNKRPSKCFAKCKHRRLRFPPMDTQNWVFVKEGMDDFRYGCPSPEDTLVCRRDEFLLPKISLRGPQADPKSGQKKLLKKAALFSKLSPAQLARKAFVEQVEAQLMAKHPLAMYPNLGEDMPPDLLLQVLKHLDPERELEDAWACCETQEKTTEVPTEPGKHPCGEFCLKPPETPVSHLLPEPPETGVSHLSPEPPKTPVSSLRPEPPETGVSHLRPEPPETGVSHIRPGPPITRRRSSLLRQLLKLDSERKLEDARAPCEGREKTTDEPTEPGKYPCGKFCPRPFETPLSHLRQEPPKTPVSSLRPEPPETGESHLRLEHSKTRRGSSLRSEPSETGVSRLRLAPPKTRRGSSLHAEPSKTGVSHLSPEPPKTEVSHLHPVPPKTGVCHLRLEPPDTSQVSNLLLYILKVLDSGRTLKDVWDRCEARVKKTKEPTEPHKSPCGEPCLQPPETQVSHPHPEHPKTRRRSSLHSQPPKTRRTSSLRSEPPKTRRTSSLRSEPPKTRRTSSLGPEPPKTRRVSSLRPELPKSRRVSSLHPEPPKAPESHQFSEPPKIRASYIKELLQEDTPSTKECVSDSLQYRYTSEKLREFFKWAGDLGADEESIRNLFDFTPKYRATHEDQKFKKVKECSSELKYSMELDEKDEDKFFSQEKYWGRKFHTPSNSYTAQRVKMKYGAWYLKPKLWKKLRSDEPLIDPKLLLKKPDEPDVLDDLYGPIAFKDFILSKGYEMPGIIQRLFARRGWTYDSVKTPIQRAMIFYKYKEIVEASEED

SEQ ID NO: 30263 - protein, 778 aa, Homo sapiens [sequence omitted]

SEQ ID NO: 30264 - protein, 645 aa, Homo sapiens
  Payload ID: 5932
  Gene Symbol: FAM47B
  Gene Name: family with sequence similarity 47, member B
  Uniprot ID: Q8NA70
  ENSP ID: ENSP00000328307
MGDRRPQDRPRSQGMDSKPWYCDKPPSKYFAKRKHRRLRFPPVDTQNWVFVTEGMDDFRYACQSPEDTLVCRRDEFLLPKISLRGPQADRKSRKKKLLKKAALFSELSPVQPARKAFVEEVEAQLMTKHPLAMYPNLGKDMPPDLLLQVLKQLDPERKLEDAWARCEAREKTTEVPTESGKYPCGESCPRPPETPVSRLRPQLPKTPVSSRRPEPPKTRVSSLRPEPPKTRVSSLHPEPPETRASHLRVDPPETGVSHLCPEPPKTLVSSVHPEPPDTGASHLCPEPPETRVSHLHPEPPETGVSHLRPEPSKTQVSSLCPEPPEAGVSHLCLEPPNTHRVSSFLLQVLKLDSEKKLEDARARCEGQEMTTEELTKPGKYHFWESCPRPFESRMPHLRLVLPITRRMASLCLKPPKTRRVSSLCPEPTKTGASHLKELFQEDTPSTMECVSDSLQRRHTSRKLRDFKWAGDLGVNEESISSLFDFTPECRTTDQDQKIKKANECASRLMYGMELDDMDEVEFLRIKYWDRRRRAAPHSYSAQRGRIRYGPWYFEPKLGKKLRSDEPLIDPKPVLEKPDEPDILDGLYGPIAFKDFILSKGYRMPGVIEKLFAKKGWTYDSVKTPIQRAVQVYKYKEDVTDASKED

SEQ ID NO: 30265 - protein, 1035 aa, Homo sapiens
  Payload ID: 5933
  Gene Symbol: FAM47C
  Gene Name: family with sequence similarity 47, member C
  Uniprot ID: Q5HY64
  ENSP ID: ENSP00000367913
MGDQRPQDRPSSPGMDSTPWYCDKPPSKYFAKRKHRRLRFPPVDTQNWVFVTEGMDDFRYGCQSPEDTLVCRRDEFLLPKISLRGPQADPKSRKKKLLKKAALFSKLSPAQPARKAFVEEVEAQLMTKHPLAMYPNLGEDMPPDLLLQVLKPLDPERKLEDAGSCEGQEKTTDEPTEPGKYPCGEFSPRPPETRVSCLPPEPPKTPVSSLRPEPPETGVSHLRPQPPKTQVSSLHLEPPETGVSHLRPEPPKTQVSSLHLEPPETGVSHLYLEPPGTGVSHLCPEPPKTRVSHLHREPPETGVPDLCLEPPKSRVSHLRPEPSETGVSHLHPEPPKTLVSSLHPEPPETGVSHLCPEPPETRVSPLRQLPPEAGVSHLCPEPPKTRVPPLRPETPKNGVSPLFPEPPKTRISNLRSEPPKIGVSHLCLEPPKTRGSHLRPEPPETGVSHLRPEPPKTRVSSLHLEPPETGVSHLCPEPPEKDVSHLRPEPPDTGVSHLCPEPPKTRVSHLRPEPSETGVSHLRPEPPKILVSSLHQAPPESSVSHLRPEPPETGVSHLRPEPPKTRMYSLRPEPPDTGVSHLCPEPPKTRVSSLPPEPPETGVSHLCPEPPETRVSHLRPEPPETGVSHLRPEPPKTRMYSLRPEPPNTGVSHLCPEPPKTRVSSLPPEPPETGVSHLCPEPPETRVSHLRPEPPETGVSRLHPEPPKTRVSSLHAEPPESRVSHLCPEPPETGVSHLRPEPPKPRVSSLRPEPLETRVSHLRPEPPETGVSHLHPELPKPRVSSLHLEPPKTRRVSSLRLEPPKTGRVSSLCPEPTKTGASHLKELFQEGTSSTMECVSDSLQRRHTSRKLRDFKWAGDLGVNEESISSLFDFTPECRATYQDQKNKKANECSSGLKYSMELDEMDEVKFFSQEKDLDGKIQNAPNSHSAQHVKMGYGAWYLKPKLGKKLRSDEPLIDPKLVLEKPDEPDILDGLYGPIAFKDFILSKGYEMPGIIQRLFARRGWTYDSVKTPIQRAMQVYKYKEDVTDASEED

SEQ ID NO: 30266 - protein, 393 aa, Homo sapiens
  Payload ID: 5934
  Gene Symbol: FAM47E
  Gene Name: family with sequence similarity 47, member E
  Uniprot ID: Q6ZV65
  ENSP ID: ENSP00000409423
MADRRRRLRPGTLAPVREGVNCRSRCFTKHKNGLKFPTSLHSRQLVFPRKGLDDFRKGCPPCTGLVTQVPVEGFLPQIYHRAPQLAPKKRQIKLLKEADVLSKLSPAQQARKAFLEDVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENGISDIDEEFILKQFDIDYETKPSHDALHTMKLNQVPLELKRSVGLSKLQETEFFQKLGYERKLQKPQNPYKPKWVKMRYGAWYLNPKLWKKQRVDEPLVDPEVSHKAQEENFKKELQEQEELLADLHGTVAFKDFILSRGYRTPRFLENMYIGKECKRACNKTPIKRTQA

SEQ ID NO: 30267 - protein, 295 aa, Homo sapiens
  Payload ID: 5934
  Gene Symbol: FAM47E
  Gene Name: family with sequence similarity 47, member E
  Uniprot ID: Q6ZV65
  ENSP ID: ENSP00000422262
MQMSVPCVLSSLQNHEPNKPLFTTQSQLLSKVLEVLDPDRKLEDTWAYCQDTRKGMKEPTKLLKKHSTQVYLGPSKKTSVSNAGQWLYEEKPHKMDLLHENGPRPGLHENVCKAVSDFCKWVTTFGISDIDEEFILKQFDIDYETKPSHDALHTMKLNQVPLELKRSVGLSKLQETEFFQKLGYERKLQKPQNPYKPKWVKMRYGAWYLNPKLWKKQRVDEPLVDPEVSHKAQEENFKKELQEQEELLADLHGTVAFKDFILSRGYRTPRFLENMYIGKECKRACNKTPIKRTQA

SEQ ID NO: 30268 - protein, 133 aa, Homo sapiens
  Payload ID: 5934
  Gene Symbol: FAM47E
  Gene Name: family with sequence similarity 47, member E
  ENSP ID: ENSP00000422559
MPASMFCLDDLGPHIELGPGGCISLSRKGHVQEWKMCKKGRRRHFTEKETLLSKVLEVLDPDRKLEDTWAYCQDTRKGMKEPTKLLKKHSTQVYLGPSKKTSVSNAGQWLYEEKPHKMDLLHENGPRPGLHEN

SEQ ID NO: 30269 - protein, 124 aa, Homo sapiens
  Payload ID: 5934
  Gene Symbol: FAM47E
  Gene Name: family with sequence similarity 47, member E
  ENSP ID: ENSP00000476166
  MOD_RES (1)..(1): Any amino acid
XVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENVCKAVSDFCKWVTTFVS

SEQ ID NO: 30270 - protein, 323 aa, Homo sapiens
  Payload ID: 5935
  Gene Symbol: FAM49A
  Gene Name: family with sequence similarity 49, member A
  Uniprot ID: Q9H0Q0
  ENSP ID: ENSP00000370724
MGNLLKVLTREIENYPHFFLDFENAQPTEGEREIWNQISAVLQDSESILADLQAYKGAGPEIRDAIQNPNDIQLQEKAWNAVCPLVVRLKRFYEFSIRLEKALQSLLESLTCPPYTPTQHLEREQALAKEFAEILHFTLRFDELKMRNPAIQNDFSYYRRTISRNRINNMHLDIENEVNNEMANRMSLFYAEATPMLKTLSNATMHFVSENKTLPIENTTDCLSTMTSVCKVMLETPEYRSRFTSEETLMFCMRVMVGVIILYDHVHPVGAFCKTSKIDMKGCIKVLKEQAPDSVEGLLNALRFTTKHLNDESTSKQIRAMLQ

SEQ ID NO: 30271 - protein, 323 aa, Homo sapiens; identical to SEQ ID NO: 30270
  Payload ID: 5935
  Gene Symbol: FAM49A
  Gene Name: family with sequence similarity 49, member A
  Uniprot ID: Q9H0Q0
  ENSP ID: ENSP00000384771

SEQ ID NO: 30272 - protein, 87 aa, Homo sapiens
  Payload ID: 5935
  Gene Symbol: FAM49A
  Gene Name: family with sequence similarity 49, member A
  ENSP ID: ENSP00000388979
MGNLLKVLTREIENYPHFFLDFENAQPTEGEREIWNQISAVLQDSESILADLQAYKGAGPEIRDAIQNPNDIQLQEKAWNAVCPLVV

SEQ ID NO: 30273 - protein, 94 aa, Homo sapiens
  Payload ID: 5935
  Gene Symbol: FAM49A
  Gene Name: family with sequence similarity 49, member A
  ENSP ID: ENSP00000392154
MGNLLKVLTREIENYPHFFLDFENAQPTEGEREIWNQISAVLQDSESILADLQAYKGAGPEIRDAIQNPNDIQLQEKAWNAVCPLVVRLKRFYE

SEQ ID NO: 30274 - protein, 324 aa, Homo sapiens
  Payload ID: 5936
  Gene Symbol: FAM49B
  Gene Name: family with sequence similarity 49, member B
  Uniprot ID: Q9NUQ9
  ENSP ID: ENSP00000384880
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 30275 - protein, 65 aa, Homo sapiens
  Payload ID: 5936
  Gene Symbol: FAM49B
  Gene Name: family with sequence similarity 49, member B
  ENSP ID: ENSP00000427994
MGNLLKVLTCTDLEQGPNFFLDFENAQPTESEKEIYNQVNVVLKDAEGILEDLQSYRGAGHEIRE

SEQ ID NO: 30276 - protein, 324 aa, Homo sapiens; identical to SEQ ID NO: 30274
  Payload ID: 5936
  Gene Symbol: FAM49B
  Gene Name: family with sequence similarity 49, member B
  Uniprot ID: Q9NUQ9
  ENSP ID: ENSP00000428117

SEQ ID NO: 30277 - protein, 100 aa, Homo sapiens
  Payload ID: 5936
  Gene Symbol: FAM49B
  Gene Name: family with sequence similarity 49, member B
  ENSP ID: ENSP00000429051
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRL

SEQ ID NO: 30278 - protein, 93 aa, Homo sapiens
  Payload ID: 5936
  Gene Symbol: FAM49B
  Gene Name: family with sequence similarity 49, member B
  ENSP ID: ENSP00000429074
MGNLLKVLTCTDLEQGPNFFLDFENAQPTESEKEIYNQVNVVLKDAEGILEDLQSYRGAGHEIREAIQHPADEKLQEKAWGAVVPLVGKLKKF

SEQ ID NO: 30279 - protein, 324 aa, Homo sapiens; identical to SEQ ID NO: 30274
  Payload ID: 5936
  Gene Symbol: FAM49B
  Gene Name: family with sequence similarity 49, member B
  Uniprot ID: Q9NUQ9
  ENSP ID: ENSP00000429078

SEQ ID NO: 30280 - protein, 324 aa, Homo sapiens; identical to SEQ ID NO: 30274
  Payload ID: 5936
  Gene Symbol: FAM49B
  Gene Name: family with sequence similarity 49, member B
  Uniprot ID: Q9NUQ9
  ENSP ID: ENSP00000429150

SEQ ID NO: 30281 - protein, 324 aa, Homo sapiens; identical to SEQ ID NO: 30274
  Payload ID: 5936
  Gene Symbol: FAM49B
  Gene Name: family with sequence similarity 49, member B
  Uniprot ID: Q9NUQ9
  ENSP ID: ENSP00000429499

SEQ ID NO: 30282 - protein, 68 aa, Homo sapiens
  Payload ID: 5936
  Gene Symbol: FAM49B
  Gene Name: family with sequence similarity 49, member B
  ENSP ID: ENSP00000429659
MGNLLKVLTCTDLEQGPNFFLDFENAQPTESEKEIYNQVNVVLKDAEGILEDLQSYRGAGHEIREAIQ

SEQ ID NO: 30283 - protein, 324 aa, Homo sapiens; identical to SEQ ID NO: 30274
  Payload ID: 5936
  Gene Symbol: FAM49B
  Gene Name: family with sequence similarity 49, member B
  Uniprot ID: Q9NUQ9
  ENSP ID: ENSP00000429802

SEQ ID NO: 30284 - protein, 47 aa, Homo sapiens
  Payload ID: 5936
  Gene Symbol: FAM49B
  Gene Name: family with sequence similarity 49, member B
  ENSP ID: ENSP00000429860
MGNLLKVLTCTDLEQGPNFFLDFENAQPTESEKEIYNQVNVVLKDAE

SEQ ID NO: 30285 - protein, 178 aa, Homo sapiens
  Payload ID: 5936
  Gene Symbol: FAM49B
  Gene Name: family with sequence similarity 49, member B
  Uniprot ID: Q9NUQ9
  ENSP ID: ENSP00000429978
MTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 30286 - protein, 78 aa, Homo sapiens
  Payload ID: 5936
  Gene Symbol: FAM49B
  Gene Name: family with sequence similarity 49, member B
  ENSP ID: ENSP00000430127
MGNLLKVLTCTDLEQGPNFFLDFENAQPTESEKEIYNQVNVVLKDAEGILEDLQSYRGAGHEIREAIQHPADEKLQEK

SEQ ID NO: 30287 - protein, 45 aa, Homo sapiens
  Payload ID: 5936
  Gene Symbol: FAM49B
  Gene Name: family with sequence similarity 49, member B
  ENSP ID: ENSP00000430412
MGNLLKVLTCTDLEQGPNFFLDFENAQPTESEKEIYNQVNVVLKD

SEQ ID NO: 30288 - protein, 178 aa, Homo sapiens; identical to SEQ ID NO: 30285
  Payload ID: 5936
  Gene Symbol: FAM49B
  Gene Name: family with sequence similarity 49, member B
  Uniprot ID: Q9NUQ9
  ENSP ID: ENSP00000430433

SEQ ID NO: 30289 - protein, 63 aa, Homo sapiens
  Payload ID: 5936
  Gene Symbol: FAM49B
  Gene Name: family with sequence similarity 49, member B
  ENSP ID: ENSP00000430434
MGNLLKVLTCTDLEQGPNFFLDFENAQPTESEKEIYNQVNVVLKDAEGILEDLQSYRGAGHEI

SEQ ID NO: 30290 - protein, 324 aa, Homo sapiens; identical to SEQ ID NO: 30274
  Payload ID: 5936
  Gene Symbol: FAM49B
  Gene Name: family with sequence similarity 49, member B
  Uniprot ID: Q9NUQ9
  ENSP ID: ENSP00000430674

SEQ ID NO: 30291 - protein, 98 aa, Homo sapiens
  Payload ID: 5936
  Gene Symbol: FAM49B
  Gene Name: family with sequence similarity 49, member B
  ENSP ID: ENSP00000430694
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQ

SEQ ID NO: 30292 - protein, 155 aa, Homo sapiens
  Payload ID: 5936
  Gene Symbol: FAM49B
  Gene Name: family with sequence similarity 49, member B
  ENSP ID: ENSP00000430806
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKVELSIGPDC

SEQ ID NO: 30293 - protein, 217 aa, Homo sapiens [sequence omitted]

SEQ ID NO: 30294 - protein, 260 aa, Homo sapiens
  Payload ID: 5937
  Gene Symbol: FAM50A
  Gene Name: family with sequence similarity 50, member A
  ENSP ID: ENSP00000158526
MKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDE

SEQ ID NO: 30295 - protein, 339 aa, Homo sapiens
  Payload ID: 5937
  Gene Symbol: FAM50A
  Gene Name: family with sequence similarity 50, member A
  Uniprot ID: Q14320
  ENSP ID: ENSP00000377225
MAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 30296 - protein, 325 aa, Homo sapiens
  Payload ID: 5938
  Gene Symbol: FAM50B
  Gene Name: family with sequence similarity 50, member B
  Uniprot ID: Q9Y247
  ENSP ID: ENSP00000369625
MAQYKGTMREAGRAMHLLKKRERQREQMEVLKQRIAEETILKSQVDKRFSAHYDAVEAELKSSTVGLVTLNDMKARQEALVRERERQLAKRQHLEEQRLQQERQREQEQRRERKRKISCLSFALDDLDDQADAAEARRAGNLGKNPDVDTSFLPDRDREEEENRLREELRQEWEAQREKVKDEEMEVTFSYWDGSGHRRTVRVRKGNTVQQFLKKALQGLRKDFLELRSAGVEQLMFIKEDLILPHYHTFYDFIIARARGKSGPLFSFDVHDDVRLLSDATMEKDESHAGKVVLRSWYEKNKHIFPASRWEAYDPEKKWDKYTIR

SEQ ID NO: 30297 - protein, 325 aa, Homo sapiens; identical to SEQ ID NO: 30296
  Payload ID: 5938
  Gene Symbol: FAM50B
  Gene Name: family with sequence similarity 50, member B
  Uniprot ID: Q9Y247
  ENSP ID: ENSP00000369627

SEQ ID NO: 30298 - protein, 398 aa, Homo sapiens
  Payload ID: 5939
  Gene Symbol: FAM53A
  Gene Name: family with sequence similarity 53, member A
  Uniprot ID: Q6NSI3
  ENSP ID: ENSP00000310057
MVTLITEKLQSQSLDDLTCKAEAGPLQYSAETLNKSGRLFPLELNDQSPWKVFSGGPPVRSQAATGPDFSFLPGLSAAAHTMGLQWQPQSPRPGAGLGAASTVDPSESTGSSTAPPTKRHCRSLSEPEELVRCRSPWRPGSSKVWTPVSKRRCDSGGSATRQGSPGAVLPRSAVWSTGPTSPATPRPSSASGGFVDSSEGSAGSGPLWCSAESCLPSTRRRPSLSQERLAGAGTPLPWASSSPTSTPALGGRRGLLRCRSQPCVLSGKRSRRKRRREEDARWTRPSLDFLKMTQTLKNSKSLCSLNYEDDDEDDTPVKTVLSSPCDSRGLPGITMPGCSQRGLRTSPVHPNLWASRESVTSDGSRRSSGDPRDGDSVGEEGVFPRARWELDLEQIENN

SEQ ID NO: 30299 - protein, 108 aa, Homo sapiens
  Payload ID: 5939
  Gene Symbol: FAM53A
  Gene Name: family with sequence similarity 53, member A
  ENSP ID: ENSP00000417615
MVTLITEKLQSQSLDDLTCKAEAGPLQYSAETLNKSGRLFPLELNDQSPWKVFSGGPPVRSQAATGPDFSFLPGLSAAAHTMGLQWQPQSPRPGAGLGAASTVDPSES

SEQ ID NO: 30300 - protein, 398 aa, Homo sapiens; identical to SEQ ID NO: 30298
  Payload ID: 5939
  Gene Symbol: FAM53A
  Gene Name: family with sequence similarity 53, member A
  Uniprot ID: Q6NSI3
  ENSP ID: ENSP00000418243

SEQ ID NO: 30301 - protein, 360 aa, Homo sapiens
  Payload ID: 5939
  Gene Symbol: FAM53A
  Gene Name: family with sequence similarity 53, member A
  ENSP ID: ENSP00000419044
MVTLITEKLQSQSLDDLTCKAEAGPLQYSAETLNKSGRLFPLELNDQSPWKVFSGGPPVRSQAATGPDFSFLPGLSAAAHTMGLQWQPQSPRPGAGLGAASTVDPSESTGSSTAPPTKRHCRSLSEPEELVRCRSPWRPGSSKVWTPVSKRRCDSGGSATRQGSPGAVLPRSAVWSTGPTSPATPRPSSASGGFVDSSEGSAGSGPLWCSAESCLPSTRRRPSLSQERLAGAGTPLPWASSSPTSTPALGGRRGLLRCRSQPCVLSGKRSRRKRRREEDARWTRPSLDFLKMTQPHSCARECESRVRGLGVSLQHLSGPSSQSRGSTLNENKTPWFEMEGNLAPEDFKKFKKPLLPQLRR

SEQ ID NO: 30302 - protein, 156 aa, Homo sapiens
  Payload ID: 5939
  Gene Symbol: FAM53A
  Gene Name: family with sequence similarity 53, member A
  ENSP ID: ENSP00000423987
  MOD_RES (1)..(1): Any amino acid
XRCDSGGSATRQGSPGAVLPRSAVWSTGPTSPATPRPSSASGGFVDSSEGSAGSGPLWCSAESCLPSTRRRPSLSQERLAGAGTPLPWASSSPTSTPALGGRRGLLRCRSQPCVLSGKRSRRKRRREEDARWTRPSLDFLKMTQVASRTVSPSMLP

SEQ ID NO: 30303 - protein, 398 aa, Homo sapiens; identical to SEQ ID NO: 30298
  Payload ID: 5939
  Gene Symbol: FAM53A
  Gene Name: family with sequence similarity 53, member A
  Uniprot ID: Q6NSI3
  ENSP ID: ENSP00000426260

SEQ ID NO: 30304 - protein, 305 aa, Homo sapiens
  Payload ID: 5940
  Gene Symbol: FAM53B
  Gene Name: family with sequence similarity 53, member B
  Uniprot ID: Q14153
  ENSP ID: ENSP00000280780
MVMVLSESLSTRGADSIACGTFSRELHTPKKMSQGPTLFSCGIMENDRWRDLDRKCPLQIDQPSTSIWECLPEKDSSLWHREAVTACAVTSLIKDLSISDHNGNPSAPPSKRQCRSLSFSDEMSSCRTSWRPLGSKVWTPVEKRRCYSGGSVQRYSNGFSTMQRSSSFSLPSRANVLSSPCDQAGLHHRFGGQPCQGVPGSAPCGQAGDTWSPDLHPVGGGRLDLQRSLSCSHEQFSFVEYCPPSANSTPASTPELARRSSGLSRSRSQPCVLNDKKVGVKRRRPEEVQEQRPSLDLAKMAQIAP

SEQ ID NO: 30305 - protein, 422 aa, Homo sapiens
  Payload ID: 5940
  Gene Symbol: FAM53B
  Gene Name: family with sequence similarity 53, member B
  Uniprot ID: Q14153
  ENSP ID: ENSP00000338532
MVMVLSESLSTRGADSIACGTFSRELHTPKKMSQGPTLFSCGIMENDRWRDLDRKCPLQIDQPSTSIWECLPEKDSSLWHREAVTACAVTSLIKDLSISDHNGNPSAPPSKRQCRSLSFSDEMSSCRTSWRPLGSKVWTPVEKRRCYSGGSVQRYSNGFSTMQRSSSFSLPSRANVLSSPCDQAGLHHRFGGQPCQGVPGSAPCGQAGDTWSPDLHPVGGGRLDLQRSLSCSHEQFSFVEYCPPSANSTPASTPELARRSSGLSRSRSQPCVLNDKKVGVKRRRPEEVQEQRPSLDLAKMAQNCQTFSSLSCLSAGTEDCGPQSPFARHVSNTRAWTALLSASGPGGRTPAGTPVPEPLPPSFDDHLACQEDLSCEESDSCALDEDCGRRAEPAAAWRDRGAPGNSLCSLDGELDIEQIEKN

SEQ ID NO: 30306 - protein, 422 aa, Homo sapiens; identical to SEQ ID NO: 30305
  Payload ID: 5940
  Gene Symbol: FAM53B
  Gene Name: family with sequence similarity 53, member B
  Uniprot ID: Q14153
  ENSP ID: ENSP00000376509

SEQ ID NO: 30307 - protein, 392 aa, Homo sapiens
  Payload ID: 5941
  Gene Symbol: FAM53C
  Gene Name: family with sequence similarity 53, member C
  Uniprot ID: Q9NYF3
  ENSP ID: ENSP00000239906
MITLITEQLQKQTLDELKCTRFSISLPLPDHADISNCGNSFQLVSEGASWRGLPHCSCAEFQDSLNFSYHPSGLSLHLRPPSRGNSPKEQPFSQVLRPEPPDPEKLPVPPAPPSKRHCRSLSVPVDLSRWQPVWRPAPSKLWTPIKHRGSGGGGGPQVPHQSPPKRVSSLRFLQAPSASSQCAPAHRPYSPPFFSLALAQDSSRPCAASPQSGSWESDAESLSPCPPQRRFSLSPSLGPQASRFLPSARSSPASSPELPWRPRGLRNLPRSRSQPCDLDARKTGVKRRHEEDPRRLRPSLDFDKMNQKPYSGGLCLQETAREGSSISPPWFMACSPPPLSASCSPTGGSSQVLSESEEEEEGAVRWGRQALSKRTLCQRDFGDLDLNLIEEN

SEQ ID NO: 30308 - protein, 392 aa, Homo sapiens; identical to SEQ ID NO: 30307
  Payload ID: 5941
  Gene Symbol: FAM53C
  Gene Name: family with sequence similarity 53, member C
  Uniprot ID: Q9NYF3
  ENSP ID: ENSP00000403705

SEQ ID NO: 30309 - protein, 114 aa, Homo sapiens
  Payload ID: 5941
  Gene Symbol: FAM53C
  Gene Name: family with sequence similarity 53, member C
  ENSP ID: ENSP00000425154
MITLITEQLQKQTLDELKCTRFSISLPLPDHADISNCGNSFQLVSVWARRQAASCPLPGALPHPPQSCPGDLEVSATFPEAAHSLVIWMPAKLGSSGATRKTPGVCGLRWTLTR

SEQ ID NO: 30310 - protein, 165 aa, Homo sapiens
  Payload ID: 5941
  Gene Symbol: FAM53C
  Gene Name: family with sequence similarity 53, member C
  ENSP ID: ENSP00000427610
MVLEWCCSGRRRLTSEPLPDHADISNCGNSFQLVSEGASWRGLPHCSCAEFQDSLNFSYHPSGLSLHLRPPSRGNSPKEQPFSQVLRPEPPDPEKLPVPPAPPSKRHCRSLSVPVDLSRWQPVWRPAPSKLWTPIKHRGSGGGGGPQVPHQSPPKRVSSLRFLQA

SEQ ID NO: 30311 - protein, 225 aa, Homo sapiens
  Payload ID: 5942
  Gene Symbol: FAM57A
  Gene Name: family with sequence similarity 57, member A
  Uniprot ID: Q8TBR7
  ENSP ID: ENSP00000301324
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 30312 - protein, 257 aa, Homo sapiens
  Payload ID: 5942
  Gene Symbol: FAM57A
  Gene Name: family with sequence similarity 57, member A
  Uniprot ID: Q8TBR7
  ENSP ID: ENSP00000312017
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQRLRGDLGDFFVGCIFTAELSTPFVSLGRVLIQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 30313 - protein, 149 aa, Homo sapiens
  Payload ID: 5942
  Gene Symbol: FAM57A
  Gene Name: family with sequence similarity 57, member A
  ENSP ID: ENSP00000458224
MLLTLAGGALFFPGLFALCTWALRRSQPGWSRTDCVMISTRYRRRRDAPRGPGRCPPHPTRPRGPGRKRGAAGSPGAAPSASRRPEFPKPLRVLPWRERGRGGREWPMSLRSPLPTSACGWGESGRRAGPGSLRSSDRTERARCSLRPR

SEQ ID NO: 30314 - protein, 113 aa, Homo sapiens
  Payload ID: 5942
  Gene Symbol: FAM57A
  Gene Name: family with sequence similarity 57, member A
  ENSP ID: ENSP00000458649
MISTRYRRRRDAPRGPGRCPPHPTRPRGPGRKRGAAGSPGAAPSASRRPEFPKPLRVLPWRERGRGGREWPMSLRSPLPTSACGWGESGRRAGPGSLRSSDRTERARCSLRPR

SEQ ID NO: 30315 - protein, 69 aa, Homo sapiens
  Payload ID: 5942
  Gene Symbol: FAM57A
  Gene Name: family with sequence similarity 57, member A
  ENSP ID: ENSP00000460150
MLLTLAGGALFFPGLFALCTWALRRSQPGWSRTDCVMISTRLVSSVHAVLATGSGIVIIRSCDDVITGS

SEQ ID NO: 30316 - protein, 38 aa, Homo sapiens
  Payload ID: 5942
  Gene Symbol: FAM57A
  Gene Name: family with sequence similarity 57, member A
  ENSP ID: ENSP00000460233
  MOD_RES (1)..(1): Any amino acid
XATGSGIVIIRSCDDVITGRGSGETLGTSLSAASSRQN

SEQ ID NO: 30317 - protein, 224 aa, Homo sapiens
  Payload ID: 5943
  Gene Symbol: FAM57B
  Gene Name: family with sequence similarity 57, member B
  Uniprot ID: Q71RH2
  ENSP ID: ENSP00000279389
MASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 30318 - protein, 274 aa, Homo sapiens
  Payload ID: 5943
  Gene Symbol: FAM57B
  Gene Name: family with sequence similarity 57, member B
  Uniprot ID: Q71RH2
  ENSP ID: ENSP00000369863
MLTPMVAGGVVFPGLFLLSKNTLQRLPQLRWEEADAVIVSARLVSSVQAIMASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 30319 - protein, 146 aa, Homo sapiens
  Payload ID: 5943
  Gene Symbol: FAM57B
  Gene Name: family with sequence similarity 57, member B
  ENSP ID: ENSP00000456854
MTLLFAVGCVFFPLCFTALRWGLQNHTNLQMERQEAVLVASKLVSSVQAIMASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPL

SEQ ID NO: 30320 - protein, 42 aa, Homo sapiens
  Payload ID: 5943
  Gene Symbol: FAM57B
  Gene Name: family with sequence similarity 57, member B
  ENSP ID: ENSP00000457712
MTLLFAVGCVFFPLCFTALRWGLQNHTNLQMERQEAVLVASK

SEQ ID NO: 30321 - protein, 170 aa, Homo sapiens
  Payload ID: 5943
  Gene Symbol: FAM57B
  Gene Name: family with sequence similarity 57, member B
  ENSP ID: ENSP00000457769
MASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQVSEHGRVQEPNGEVTGRGGTFKVAAKGSSPFVIPPSPRAF

SEQ ID NO: 30322 - protein, 17 aa, Homo sapiens
  Payload ID: 5943
  Gene Symbol: FAM57B
  Gene Name: family with sequence similarity 57, member B
  ENSP ID: ENSP00000458640
MTLLFAVGCVFFPLCFT

SEQ ID NO: 30323 - protein, 228 aa, Homo sapiens
  Payload ID: 5944
  Gene Symbol: FAM58A
  Gene Name: family with sequence similarity 58, member A
  Uniprot ID: Q8N1B3
  ENSP ID: ENSP00000402949
MEAPEGGGGGPAARGPEGQPAPEARVHFRVARFIMEAGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQIYTMDTEIP

SEQ ID NO: 30324 - protein, 94 aa, Homo sapiens
  Payload ID: 5944
  Gene Symbol: FAM58A
  Gene Name: family with sequence similarity 58, member A
  ENSP ID: ENSP00000412865
  MOD_RES (1)..(1): Any amino acid
XAGKVEEQHLRTRDIINVSNRYFNPSGEPLELDSRFWELRDSIVQCELLMLRVLRFQVSFQHPHKVFNDDLTKPIIDNIVSDLIQIYTMDTEIP

SEQ ID NO: 30325 - protein, 248 aa, Homo sapiens
  Payload ID: 5944
  Gene Symbol: FAM58A
  Gene Name: family with sequence similarity 58, member A
  Uniprot ID: Q8N1B3
  ENSP ID: ENSP00000461135
MEAPEGGGGGPAARGPEGQPAPEARVHFRVARFIMEAGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQVFNDDLTKPIIDNIVSDLIQIYTMDTEIP

SEQ ID NO: 30326 - protein, 141 aa, Homo sapiens
  Payload ID: 5944
  Gene Symbol: FAM58A
  Gene Name: family with sequence similarity 58, member A
  ENSP ID: ENSP00000466345
MRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALC

SEQ ID NO: 30327 - protein, 39 aa, Homo sapiens
  Payload ID: 5944
  Gene Symbol: FAM58A
  Gene Name: family with sequence similarity 58, member A
  ENSP ID: ENSP00000478747
MEAPEGGGGGPAARGPEGQPAPEARVHFRVARFIMEVSS

SEQ ID NO: 30328 - protein, 39 aa, Homo sapiens
  Payload ID: 5944
  Gene Symbol: FAM58A
  Gene Name: family with sequence similarity 58, member A
  ENSP ID: ENSP00000481634
MEAPEGGGGGPAARGPEGQPAPEARVHFRVARFIMEAGG

SEQ ID NO: 30329 - protein, 96 aa, Homo sapiens
  Payload ID: 5944
  Gene Symbol: FAM58A
  Gene Name: family with sequence similarity 58, member A
  ENSP ID: ENSP00000483391
  MOD_RES (1)..(1): Any amino acid
XPGGAAGARSQGALPSGEVHHGGVKLGMRSIPIATACTIYHKFFCETNLDAYDPYLIAMSSIYLAGKVEEQHLRTRDIINVSNSTCSTTWFPSRTG

SEQ ID NO: 30330 - protein, 39 aa, Homo sapiens; identical to SEQ ID NO: 30327
  Payload ID: 5944
  Gene Symbol: FAM58A
  Gene Name: family with sequence similarity 58, member A
  ENSP ID: ENSP00000484108

SEQ ID NO: 30331 - protein, 170 aa, Homo sapiens
  Payload ID: 5944
  Gene Symbol: FAM58A
  Gene Name: family with sequence similarity 58, member A
  ENSP ID: ENSP00000484506
  MOD_RES (1)..(1): Any amino acid
XGGGPAARGPEGQPAPEARVHFRVARFIMEAGVKLGMRSIPIATACTIYHKFFCETNLDAYDPYLIAMSSIYLAGKVEEQHLRTRDIINVSNRFIPWTQRSPKVLAQACPKRSPGWSAAWGHCHHVAMTAGPHRTSWEDWLCCWRRAGEGNGMLPLCQSLEVAVQVMVGA

SEQ ID NO: 30332 - protein, 221 aa, Homo sapiens
  Payload ID: 5945
  Gene Symbol: FAM60A
  Gene Name: family with sequence similarity 60, member A
  Uniprot ID: Q9NP50
  ENSP ID: ENSP00000337477
MFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTSSASPAQSPCYSNQSDDGSDTEMASGSNRTPVFSFLDLTYWKRQKICCGIIYKGRFGEVLIDTHLFKPCCSNKKAAAEKPEEQGPEPLPISTQEW

SEQ ID NO: 30333 - protein, 221 aa, Homo sapiens; identical to SEQ ID NO: 30332
  Payload ID: 5945
  Gene Symbol: FAM60A
  Gene Name: family with sequence similarity 60, member A
  Uniprot ID: Q9NP50
  ENSP ID: ENSP00000393279

SEQ ID NO: 30334 - protein, 126 aa, Homo sapiens
  Payload ID: 5945
  Gene Symbol: FAM60A
  Gene Name: family with sequence similarity 60, member A
  ENSP ID: ENSP00000437363
MFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTT

SEQ ID NO: 30335 - protein, 73 aa, Homo sapiens
  Payload ID: 5945
  Gene Symbol: FAM60A
  Gene Name: family with sequence similarity 60, member A
  Uniprot ID: Q9NP50
  ENSP ID: ENSP00000439952
MASGSNRTPVFSFLDLTYWKRQKICCGIIYKGRFGEVLIDTHLFKPCCSNKKAAAEKPEEQGPEPLPISTQEW

SEQ ID NO: 30336 - protein, 59 aa, Homo sapiens
  Payload ID: 5945
  Gene Symbol: FAM60A
  Gene Name: family with sequence similarity 60, member A
  ENSP ID: ENSP00000443087
  MOD_RES (1)..(1): Any amino acid
XRSIEGCCICRAKSSSSRFTDSKRYEKDFQSCFGDNVFLCCLGWSAVAIHRCDHCAPQP

SEQ ID NO: 30337 - protein, 73 aa, Homo sapiens; identical to SEQ ID NO: 30335
  Payload ID: 5945
  Gene Symbol: FAM60A
  Gene Name: family with sequence similarity 60, member A
  Uniprot ID: Q9NP50
  ENSP ID: ENSP00000443697

SEQ ID NO: 30338 - protein, 134 aa, Homo sapiens
  Payload ID: 5945
  Gene Symbol: FAM60A
  Gene Name: family with sequence similarity 60, member A
  ENSP ID: ENSP00000443881
MFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTSSASPAQS

SEQ ID NO: 30339 - protein, 221 aa, Homo sapiens; identical to SEQ ID NO: 30332
  Payload ID: 5945
  Gene Symbol: FAM60A
  Gene Name: family with sequence similarity 60, member A
  Uniprot ID: Q9NP50
  ENSP ID: ENSP00000479093

SEQ ID NO: 30340 - protein, 126 aa, Homo sapiens; identical to SEQ ID NO: 30334
  Payload ID: 5945
  Gene Symbol: FAM60A
  Gene Name: family with sequence similarity 60, member A
  ENSP ID: ENSP00000487725

SEQ ID NO: 30341 - protein, 134 aa, Homo sapiens; identical to SEQ ID NO: 30338
  Payload ID: 5945
  Gene Symbol: FAM60A
  Gene Name: family with sequence similarity 60, member A
  ENSP ID: ENSP00000487860

SEQ ID NO: 30342 - protein, 59 aa, Homo sapiens; identical to SEQ ID NO: 30336
  Payload ID: 5945
  Gene Symbol: FAM60A
  Gene Name: family with sequence similarity 60, member A
  ENSP ID: ENSP00000488054
  MOD_RES (1)..(1): Any amino acid

SEQ ID NO: 30343 - protein, 73 aa, Homo sapiens; identical to SEQ ID NO: 30335
  Payload ID: 5945
  Gene Symbol: FAM60A
  Gene Name: family with sequence similarity 60, member A
  Uniprot ID: Q9NP50
  ENSP ID: ENSP00000488406

SEQ ID NO: 30344 - protein, 221 aa, Homo sapiens; identical to SEQ ID NO: 30332
  Payload ID: 5945
  Gene Symbol: FAM60A
  Gene Name: family with sequence similarity 60, member A
  Uniprot ID: Q9NP50
  ENSP ID: ENSP00000488570

SEQ ID NO: 30345 - protein, 73 aa, Homo sapiens; identical to SEQ ID NO: 30335
  Payload ID: 5945
  Gene Symbol: FAM60A
  Gene Name: family with sequence similarity 60, member A
  Uniprot ID: Q9NP50
  ENSP ID: ENSP00000488852

SEQ ID NO: 30346 - protein, 327 aa, Homo sapiens
  Payload ID: 5946
  Gene Symbol: FAM63A
  Gene Name: family with sequence similarity 63, member A
  Uniprot ID: Q8N5J2
  ENSP ID: ENSP00000310923
MNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPETQLQVDQDYLIALSLQQQQPRGPLGLTDLELAQQLQQEEYQQQQAAQPVRMRTRVLSLQGRGATSGRPAGERRQRPKHESDCILL

SEQ ID NO: 30347 - protein, 517 aa, Homo sapiens
  Payload ID: 5946
  Gene Symbol: FAM63A
  Gene Name: family with sequence similarity 63, member A
  Uniprot ID: Q8N5J2
  ENSP ID: ENSP00000354669
MLLGPPPFNESTKPSPSPCHSFASQAWLRQVPEVSKHLQCPSAKSLLTMEYHQPEDPAPGKAGTAEAVIPENHEVLAGPDEHPQDTDARDADGEAREREPADQALLPSQCGDNLESPLPEASSAPPGPTLGTLPEVETIRACSMPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPETQLQVDQDYLIALSLQQQQPRGPLGLTDLELAQQLQQEEYQQQQAAQPVRMRTRVLSLQGRGATSGRPAGERRQRPKHESDCILL

SEQ ID NO: 30348 - protein, 469 aa, Homo sapiens
  Payload ID: 5946
  Gene Symbol: FAM63A
  Gene Name: family with sequence similarity 63, member A
  Uniprot ID: Q8N5J2
  ENSP ID: ENSP00000354814
MEYHQPEDPAPGKAGTAEAVIPENHEVLAGPDEHPQDTDARDADGEAREREPADQALLPSQCGDNLESPLPEASSAPPGPTLGTLPEVETIRACSMPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPETQLQVDQDYLIALSLQQQQPRGPLGLTDLELAQQLQQEEYQQQQAAQPVRMRTRVLSLQGRGATSGRPAGERRQRPKHESDCILL

SEQ ID NO: 30349 - protein, 374 aa, Homo sapiens
  Payload ID: 5946
  Gene Symbol: FAM63A
  Gene Name: family with sequence similarity 63, member A
  Uniprot ID: Q8N5J2
  ENSP ID: ENSP00000437174
MPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPETQLQVDQDYLIALSLQQQQPRGPLGLTDLELAQQLQQEEYQQQQAAQPVRMRTRVLSLQGRGATSGRPAGERRQRPKHESDCILL

SEQ ID NO: 30350 - protein, 142 aa, Homo sapiens
  Payload ID: 5946
  Gene Symbol: FAM63A
  Gene Name: family with sequence similarity 63, member A
  ENSP ID: ENSP00000451524
  MOD_RES (1)..(1): Any amino acid
XDFHLSHSLGKGPGAEGGSGSPETQLQVDQDYLIALSLQQQQPRGPLGLTDLELAQQLQQEEYQQQQAAQPVRMRTRVLSLQVGCCLGAHTPGFHLMLCRVQNTCYSCTGLFKVSSLRVLPLPVPLPWSPFLSSSPYSLSQS

SEQ ID NO: 30351 - protein, 469 aa, Homo sapiens; identical to SEQ ID NO: 30348
  Payload ID: 5946
  Gene Symbol: FAM63A
  Gene Name: family with sequence similarity 63, member A
  Uniprot ID: Q8N5J2
  ENSP ID: ENSP00000481304

SEQ ID NO: 30352 - protein, 422 aa, Homo sapiens
  Payload ID: 5947
  Gene Symbol: FAM63B
  Gene Name: family with sequence similarity 63, member B
  ENSP ID: ENSP00000326194
MESSPESLQPLEHGVAAGPASGTGSSQEGLQETRLAAGDGPGVWAAETSGGNGLGAAAARRSLPDSASPAGSPEVPGPCSSSAGLDLKDSGLESPAAAEAPLRGQYKVTASPETAVAGVGHELGTAGDAGARPDLAGTCQAELTAAGSEEPSSAGGLSSSCSDPSPPGESPSLDSLESFSNLHSFPSSCEFNSEEGAENRVPEEEEGAAVLPGAVPLCKEEEGEETAQVLAASKERFPGQSVYHIKWIQWKEENTPIITQNENGPCPLLAILNVLLLAWKVKLPPMMEIITAEQLMEYLGDYMLDAKPKEISEIQRLNYEQNMSDAMAILHKLQTGLDVNVRFTGVRVFEYTPECIVFDLLDIPLYHGWLVDPQIDDIVKAVGNCSYNQLVEKIISCKQSDNSELVSEGSTVFVGNGPGVSY

SEQ ID NO: 30353 - protein, 620 aa, Homo sapiens
  Payload ID: 5947
  Gene Symbol: FAM63B
  Gene Name: family with sequence similarity 63, member B
  Uniprot ID: Q8NBR6
  ENSP ID: ENSP00000393231
MESSPESLQPLEHGVAAGPASGTGSSQEGLQETRLAAGDGPGVWAAETSGGNGLGAAAARRSLPDSASPAGSPEVPGPCSSSAGLDLKDSGLESPAAAEAPLRGQYKVTASPETAVAGVGHELGTAGDAGARPDLAGTCQAELTAAGSEEPSSAGGLSSSCSDPSPPGESPSLDSLESFSNLHSFPSSCEFNSEEGAENRVPEEEEGAAVLPGAVPLCKEEEGEETAQVLAASKERFPGQSVYHIKWIQWKEENTPIITQNENGPCPLLAILNVLLLAWKVKLPPMMEIITAEQLMEYLGDYMLDAKPKEISEIQRLNYEQNMSDAMAILHKLQTGLDVNVRFTGVRVFEYTPECIVFDLLDIPLYHGWLVDPQIDDIVKAVGNCSYNQLVEKIISCKQSDNSELVSEGFVAEQFLNNTATQLTYHGLCELTSTVQEGELCVFFRNNHFSTMTKYKGQLYLLVTDQGFLTEEKVVWESLHNVDGDGNFCDSEFHLRPPSDPETVYKGQQDQIDQDYLMALSLQQEQQSQEINWEQIPEGISDLELAKKLQEEEDRRASQYYQEQEQAAAAAAAASTQAQGQPAQASPSSGRQSGNSERKRKEPREKDKEKEKEKNSCVIL

SEQ ID NO: 30354 - protein, 621 aa, Homo sapiens
  Payload ID: 5947
  Gene Symbol: FAM63B
  Gene Name: family with sequence similarity 63, member B
  Uniprot ID: Q8NBR6
  ENSP ID: ENSP00000452885
MESSPESLQPLEHGVAAGPASGTGSSQEGLQETRLAAGDGPGVWAAETSGGNGLGAAAARRSLPDSASPAGSPEVPGPCSSSAGLDLKDSGLESPAAAEAPLRGQYKVTASPETAVAGVGHELGTAGDAGARPDLAGTCQAELTAAGSEEPSSAGGLSSSCSDPSPPGESPSLDSLESFSNLHSFPSSCEFNSEEGAENRVPEEEEGAAVLPGAVPLCKEEEGEETAQVLAASKERFPGQSVYHIKWIQWKEENTPIITQNENGPCPLLAILNVLLLAWKVKLPPMMEIITAEQLMEYLGDYMLDAKPKEISEIQRLNYEQNMSDAMAILHKLQTGLDVNVRFTGVRVFEYTPECIVFDLLDIPLYHGWLVDPQIDDIVKAVGNCSYNQLVEKIISCKQSDNSELVSEGFVAEQFLNNTATQLTYHGLCELTSTVQEGELCVFFRNNHFSTMTKYKGQLYLLVTDQGFLTEEKVVWESLHNVDGDGNFCDSEFHLRPPSDPETVYKGQQDQIDQDYLMALSLQQEQQSQEINWEQIPEGISDLELAKKLQEEEDRRASQYYQEQEQAAAAAAAASTQAQQGQPAQASPSSGRQSGNSERKRKEPREKDKEKEKEKNSCVIL

SEQ ID NO: 30355 - protein, 379 aa, Homo sapiens
  Payload ID: 5947
  Gene Symbol: FAM63B
  Gene Name: family with sequence similarity 63, member B
  ENSP ID: ENSP00000453425
MESSPESLQPLEHGVAAGPASGTGSSQEGLQETRLAAGDGPGVWAAETSGGNGLGAAAARRSLPDSASPAGSPEVPGPCSSSAGLDLKDSGLESPAAAEAPLRGQYKVTASPETAVAGVGHELGTAGDAGARPDLAGTCQAELTAAGSEEPSSAGGLSSSCSDPSPPGESPSLDSLESFSNLHSFPSSCEFNSEEGAENRVPEEEEGAAVLPGAVPLCKEEEGEETAQVLAASKERFPGQSVYHIKWIQWKEENTPIITQNENGPCPLLAILNVLLLAWKVKLPPMMEIITAEQLMEYLGDYMLDAKPKEISEIQRLNYEQNMSDAMAILHKLQTGLDVNIDDIVKAVGNCSYNQLVEKIISCKQSDNSELVSEGGLCS

SEQ ID NO: 30356 - protein, 248 aa, Homo sapiens
  Payload ID: 5948
  Gene Symbol: FAM64A
  Gene Name: family with sequence similarity 64, member A
  Uniprot ID: Q9BSJ6
  ENSP ID: ENSP00000250056
MASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEERKQALSDRQGFILKDVYASP

SEQ ID NO: 30357 - protein, 238 aa, Homo sapiens
  Payload ID: 5948
  Gene Symbol: FAM64A
  Gene Name: family with sequence similarity 64, member A
  Uniprot ID: Q9BSJ6
  ENSP ID: ENSP00000458534
MASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEESGDIVSLIHD

SEQ ID NO: 30358 - protein, 279 aa, Homo sapiens
  Payload ID: 5948
  Gene Symbol: FAM64A
  Gene Name: family with sequence similarity 64, member A
  ENSP ID: ENSP00000458584
MASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQGINFRSCREGPVRGDLLSNESCCQEDVLILDRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEERKQALSDRQGFILKDVYASP

SEQ ID NO: 30359 - protein, 238 aa, Homo sapiens; identical to SEQ ID NO: 30357
  Payload ID: 5948
  Gene Symbol: FAM64A
  Gene Name: family with sequence similarity 64, member A
  Uniprot ID: Q9BSJ6
  ENSP ID: ENSP00000459235

SEQ ID NO: 30360 - protein, 247 aa, Homo sapiens
  Payload ID: 5948
  Gene Symbol: FAM64A
  Gene Name: family with sequence similarity 64, member A
  ENSP ID: ENSP00000459597
MASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEERTLRGSSVPCLPMELGKAT

SEQ ID NO: 30361 - protein, 130 aa, Homo sapiens
  Payload ID: 5948
  Gene Symbol: FAM64A
  Gene Name: family with sequence similarity 64, member A
  ENSP ID: ENSP00000459860
  MOD_RES (1)..(1): Any amino acid
XWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEESGDIVSLIHD

SEQ ID NO: 30362 - protein, 247 aa, Homo sapiens; identical to SEQ ID NO: 30360
  Payload ID: 5948
  Gene Symbol: FAM64A
  Gene Name: family with sequence similarity 64, member A
  ENSP ID: ENSP00000460894

SEQ ID NO: 30363 - protein, 178 aa, Homo sapiens
  Payload ID: 5948
  Gene Symbol: FAM64A
  Gene Name: family with sequence similarity 64, member A
  ENSP ID: ENSP00000460912
MASRWQNMGTSVRRRSLQHQEQLEDSKELQPVVSHQETSVGALGSLCRQFQRRLPLRAVNLNLRAGPSWKRLETPEPENPGVLPKWHQVAGGDPGEGQEAEERSTEGQWIPNSQPEPEEHPAVWSRPCPLSRRPLGEGASPPLCPDGLTCPPITAIKAGGCLPEPLLLNRAPLLSQRV

SEQ ID NO: 30364 - protein, 1219 aa, Homo sapiens
  Payload ID: 5949
  Gene Symbol: FAM65A
  Gene Name: family with sequence similarity 65, member A
  Uniprot ID: Q6ZS17
  ENSP ID: ENSP00000042381
MMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 30365 - protein, 1223 aa, Homo sapiens
  Payload ID: 5949
  Gene Symbol: FAM65A
  Gene Name: family with sequence similarity 65, member A
  Uniprot ID: Q6ZS17
  ENSP ID: ENSP00000368614
MMSLSVRPQRRLLSARVNRSQSFAGVLGSHERGPSLSFRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 30366 - protein, 1233 aa, Homo sapiens
  Payload ID: 5949
  Gene Symbol: FAM65A
  Gene Name: family with sequence similarity 65, member A
  Uniprot ID: Q6ZS17
  ENSP ID: ENSP00000389456
MNTKKRGSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 30367 - protein, 1239 aa, Homo sapiens
  Payload ID: 5949
  Gene Symbol: FAM65A
  Gene Name: family with sequence similarity 65, member A
  Uniprot ID: Q6ZS17
  ENSP ID: ENSP00000400099
MTIWQMQKQAQRGSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 30368 - protein, 1238 aa, Homo sapiens
  Payload ID: 5949
  Gene Symbol: FAM65A
  Gene Name: family with sequence similarity 65, member A
  ENSP ID: ENSP00000443568
MTIWQMQKQAQRGSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 30369 - protein, 589 aa, Homo sapiens
  Payload ID: 5949
  Gene Symbol: FAM65A
  Gene Name: family with sequence similarity 65, member A
  ENSP ID: ENSP00000454376
MNTKKRGSPARTHSMMSLSVRPQRRLLSARVNRSQSFAGVLGSHERGPRAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTP

SEQ ID NO: 30370 - protein, 140 aa, Homo sapiens
  Payload ID: 5949
  Gene Symbol: FAM65A
  Gene Name: family with sequence similarity 65, member A
  ENSP ID: ENSP00000455200
  MOD_RES (1)..(1): Any amino acid
XRMKGLAGFARLCVGDQYEAASSYLFPQICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTV

SEQ ID NO: 30371 - protein, 8 aa, Homo sapiens
  Payload ID: 5949
  Gene Symbol: FAM65A
  Gene Name: family with sequence similarity 65, member A
  ENSP ID: ENSP00000455239
MMSLSVRP

SEQ ID NO: 30372 - protein, 152 aa, Homo sapiens
  Payload ID: 5949
  Gene Symbol: FAM65A
  Gene Name: family with sequence similarity 65, member A
  ENSP ID: ENSP00000455795
MMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRL

SEQ ID NO: 30373 - protein, 88 aa, Homo sapiens
  Payload ID: 5949
  Gene Symbol: FAM65A
  Gene Name: family with sequence similarity 65, member A
  ENSP ID: ENSP00000456525
MMSLSVRPQRRLLSARVNRSQSFAGVLGSHERGPRSFPVFSPPGPPRKPPALSRVSRMFSVAHPAAKVPQPERLDLVYTALKRGLTAY

SEQ ID NO: 30374 - protein, 627 aa, Homo sapiens
  Payload ID: 5949
  Gene Symbol: FAM65A
  Gene Name: family with sequence similarity 65, member A
  ENSP ID: ENSP00000456893
MMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPT

SEQ ID NO: 30375 - protein, 156 aa, Homo sapiens
  Payload ID: 5949
  Gene Symbol: FAM65A
  Gene Name: family with sequence similarity 65, member A
  ENSP ID: ENSP00000456924
  MOD_RES (1)..(1): Any amino acid
XVRHLYHCSRLLLKLGTFGPLRCQEAWALERLLREARVLEAVCEFSRRWEIPASSAQEVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNK

SEQ ID NO: 30376 - protein, 202 aa, Homo sapiens
  Payload ID: 5949
  Gene Symbol: FAM65A
  Gene Name: family with sequence similarity 65, member A
  ENSP ID: ENSP00000457419
  MOD_RES (1)..(1): Any amino acid
XRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKSSPLNASCDDWSSMPARSMSCMRHTVSSGVSGMVPTTWSVPTPLGPREAERPGTAWQRPLGGIASTRRACVCWRASWRHSWASFISE

SEQ ID NO: 30377 - protein, 96 aa, Homo sapiens
  Payload ID: 5949
  Gene Symbol: FAM65A
  Gene Name: family with sequence similarity 65, member A
  ENSP ID: ENSP00000457739
MMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQ

SEQ ID NO: 30378 - protein, 52 aa, Homo sapiens
  Payload ID: 5949
  Gene Symbol: FAM65A
  Gene Name: family with sequence similarity 65, member A
  ENSP ID: ENSP00000457888
MTIWQMQKQAQRGSPARTHSMMSLSVRPQRRLLSARVNRSQSFAGVLGSHER

SEQ ID NO: 30379 - protein, 1068 aa, Homo sapiens
  Payload ID: 5950
  Gene Symbol: FAM65B
  Gene Name: family with sequence similarity 65, member B
  Uniprot ID: Q9Y4F9
  ENSP ID: ENSP00000259698
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFRWLHPSPDKPRRLSVLSALQDTFFAKLHRSRSFSDLPSLRPSPKAVLELYSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKCKPAVSRSRSSSLSLTVESALESFDFLNTSDFDEEEDGDEVCNVGGGADSVFSDTETEKHSYRSVHPEARGHLSEALTEDTGVGTSVAGSPLPLTTGNESLDITIVRHLQYCTQLVQQIVFSSKTPFVARSLLEKLSRQIQVMEKLAAVSDENIGNISSVVEAIPEFHKKLSLLSFWTKCCSPVGVYHSPADRVMKQLEASFARTVNKEYPGLADPVFRTLVSQILDRAEPLLSSSLSSEVVTVFQYYSYFTSHGVSDLESYLSQLARQVSMVQTLQSLRDEKLLQTMSDLAPSNLLAQQEVLRTLALLLTREDNEVSEAVTLYLAAASKNQHFREKALLYYCEALTKTNLQLQKAACLALKILEATESIKMLVTLCQSDTEEIRNVASETLLSLGEDGRLAYEQLDKFPRDCVKVGGRHGTEVATAF

SEQ ID NO: 30380 - protein, 591 aa, Homo sapiens
  Payload ID: 5950
  Gene Symbol: FAM65B
  Gene Name: family with sequence similarity 65, member B
  Uniprot ID: Q9Y4F9
  ENSP ID: ENSP00000367262
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKK

SEQ ID NO: 30381 - protein, 613 aa, Homo sapiens
  Payload ID: 5950
  Gene Symbol: FAM65B
  Gene Name: family with sequence similarity 65, member B
  ENSP ID: ENSP00000438425
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKDAKHLDDQKLNGAASWTEITEGE

SEQ ID NO: 30382 - protein, 1047 aa, Homo sapiens
  Payload ID: 5950
  Gene Symbol: FAM65B
  Gene Name: family with sequence similarity 65, member B
  ENSP ID: ENSP00000441138
MQFFDAEELLVDEEDDVFGEGLPTRLPEIMLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKCKPAVSRSRSSSLSLTVESALESFDFLNTSDFDEEEDGDEVCNVGGGADSVFSDTETEKHSYRSVHPEARGHLSEALTEDTGVGTSVAGSPLPLTTGNESLDITIVRHLQYCTQLVQQIVFSSKTPFVARSLLEKLSRQIQVMEKLAAVSDENIGNISSVVEAIPEFHKKLSLLSFWTKCCSPVGVYHSPADRVMKQLEASFARTVNKEYPGLADPVFRTLVSQILDRAEPLLSSSLSSEVVTVFQYYSYFTSHGVSDLESYLSQLARQVSMVQTLQSLRDEKLLQTMSDLAPSNLLAQQEVLRTLALLLTREDNEVSEAVTLYLAAASKNQHFREKALLYYCEALTKTNLQLQKAACLALKILEATESIKMLVTLCQSDTEEIRNVASETLLSLGEDGRLAYEQLDKFPRDCVKVGGRHGTEVATAF

SEQ ID NO: 30383 - protein, 647 aa, Homo sapiens
  Payload ID: 5950
  Gene Symbol: FAM65B
  Gene Name: family with sequence similarity 65, member B
  ENSP ID: ENSP00000441305
MVLPSRLHWIRNRPWRDRIRRRQLNRLPTRLPEIMLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKDAKHLDDQKLNGAASWTEITEGE

SEQ ID NO: 30384 - protein, 536 aa, Homo sapiens [sequence omitted]

SEQ ID NO: 30385 - protein, 1068 aa, Homo sapiens; identical to SEQ ID NO: 30379
  Payload ID: 5950
  Gene Symbol: FAM65B
  Gene Name: family with sequence similarity 65, member B
  Uniprot ID: Q9Y4F9
  ENSP ID: ENSP00000482957

SEQ ID NO: 30386 - protein, 946 aa, Homo sapiens
  Payload ID: 5951
  Gene Symbol: FAM65C
  Gene Name: family with sequence similarity 65, member C
  Uniprot ID: Q96MK2
  ENSP ID: ENSP00000045083
MSVRLRFLSPGDTGAVGVVGRSASFAGFSSAQSRRIAKSINRNSVRSRMPAKSSKMYGTLRKGSVCADPKPQQVKKIFEALKRGLKEYLCVQQAELDHLSGRHKDTRRNSRLAFYYDLDKQTRCVERHIRKMEFHISKVDELYEDYCIQCRLRDGASSMQRAFARCPPSRAARESLQELGRSLHECAEDMWLIEGALEVHLGEFHIRMKGLVGYARLCPGDHYEVLMRLGRQRWKLKGRIESDDSQTWDEEEKAFIPTLHENLDIKVTELRGLGSLAVGAVTCDIADFFTTRPQVIVVDITELGTIKLQLEVQWNPFDTESFLVSPSPTGKFSMGSRKGSLYNWTPPSTPSFRERYYLSVLQQPTQQALLLGGPRATSILSYLSDSDLRGPSLRSQSQELPEMDSFSSEDPRDTETSTSASTSDVGFLPLTFGPHASIEEEAREDPLPPGLLPEMAHLSGGPFAEQPGWRNLGGESPSLPQGSLFHSGTASSSQNGHEEGATGDREDGPGVALEGPLQEVLELLRPTDSTQPQLRELEYQVLGFRDRLKPCRARQEHTSAESLMECILESFAFLNADFALDELSLFGGSQGLRKDRPLPPPSSLKASSRELTAGAPELDVLLMVHLQVCKALLQKLASPNLSRLVQECLLEEVAQQKHVLETLSVLDFEKVGKATSIEEIIPQASRTKGCLKLWRGCTGPGRVLSCPATTLLNQLKKTFQHRVRGKYPGQLEIACRRLLEQVVSCGGLLPGAGLPEEQIITWFQFHSYLQRQSVSDLEKHFTQLTKEVTLIEELHCAGQAKVVRKLQGKRLGQLQPLPQTLRAWALLQLDGTPRVCRAASARLAGAVRNRSFREKALLFYTNALAENDARLQQAACLALKHLKGIESIDQTASLCQSDLEAVRAAARETTLSFGEKGRLAFEKMDKLCSEQREVFCQEADVEITIF

SEQ ID NO: 30387 - protein, 946 aa, Homo sapiens; identical to SEQ ID NO: 30386
  Payload ID: 5951
  Gene Symbol: FAM65C
  Gene Name: family with sequence similarity 65, member C
  Uniprot ID: Q96MK2
  ENSP ID: ENSP00000332663

SEQ ID NO: 30388 - protein, 428 aa, Homo sapiens
  Payload ID: 5952
  Gene Symbol: FAM69A
  Gene Name: family with sequence similarity 69, member A
  Uniprot ID: Q5T7M9
  ENSP ID: ENSP00000359333
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 30389 - protein, 403 aa, Homo sapiens
  Payload ID: 5952
  Gene Symbol: FAM69A
  Gene Name: family with sequence similarity 69, member A
  ENSP ID: ENSP00000482478
MKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 30390 - protein, 369 aa, Homo sapiens
  Payload ID: 5952
  Gene Symbol: FAM69A
  Gene Name: family with sequence similarity 69, member A
  ENSP ID: ENSP00000482718
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 30391 - protein, 162 aa, Homo sapiens
  Payload ID: 5952
  Gene Symbol: FAM69A
  Gene Name: family with sequence similarity 69, member A
  Uniprot ID: Q5T7M9
  ENSP ID: ENSP00000483279
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKDQHR

SEQ ID NO: 30392 - protein, 383 aa, Homo sapiens
  Payload ID: 5952
  Gene Symbol: FAM69A
  Gene Name: family with sequence similarity 69, member A
  ENSP ID: ENSP00000484866
MARSLCPGAWLRKPYYLQCDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 30393 - protein, 344 aa, Homo sapiens
  Payload ID: 5953
  Gene Symbol: FAM69B
  Gene Name: family with sequence similarity 69, member B
  Uniprot ID: Q5VUD6
  ENSP ID: ENSP00000360756
MVEWRTCLSVAPGQQVYSGLWRDKDVTIKCGIEETLDSKARSDAAPRRELVLFDKPTRGTSIKEFREMTLSFLKANLGDLPSLPALVGQVLLMADFNKDNRVSLAEAKSVWALLQRNEFLLLLSLQEKEHASRLLGYCGDLYLTEGVPHGAWHAAALPPLLRPLLPPALQGALQQWLGPAWPWRAKIAIGLLEFVEELFHGSYGTFYMCETTLANVGYTATYDFKMADLQQVAPEATVRRFLQGRRCEHSTDCTYGRDCRAPCDRLMRQCKGDLIQPNLAKVCALLRGYLLPGAPADLREELGTQLRTCTTLSGLASQVEAHHSLVLSHLKTLLWKKISNTKYS

SEQ ID NO: 30394 - protein, 431 aa, Homo sapiens
  Payload ID: 5953
  Gene Symbol: FAM69B
  Gene Name: family with sequence similarity 69, member B
  Uniprot ID: Q5VUD6
  ENSP ID: ENSP00000360757
MRRLRRLAHLVLFCPFSKRLQGRLPGLRVRCIFLAWLGVFAGSWLVYVHYSSYSERCRGHVCQVVICDQYRKGIISGSVCQDLCELHMVEWRTCLSVAPGQQVYSGLWRDKDVTIKCGIEETLDSKARSDAAPRRELVLFDKPTRGTSIKEFREMTLSFLKANLGDLPSLPALVGQVLLMADFNKDNRVSLAEAKSVWALLQRNEFLLLLSLQEKEHASRLLGYCGDLYLTEGVPHGAWHAAALPPLLRPLLPPALQGALQQWLGPAWPWRAKIAIGLLEFVEELFHGSYGTFYMCETTLANVGYTATYDFKMADLQQVAPEATVRRFLQGRRCEHSTDCTYGRDCRAPCDRLMRQCKGDLIQPNLAKVCALLRGYLLPGAPADLREELGTQLRTCTTLSGLASQVEAHHSLVLSHLKTLLWKKISNTKYS

SEQ ID NO: 30395 - protein, 266 aa, Homo sapiens
  Payload ID: 5953
  Gene Symbol: FAM69B
  Gene Name: family with sequence similarity 69, member B
  ENSP ID: ENSP00000479422
MVEWRTCLSVAPGQQVYSGLWRDKDVTIKCGIEETLDSKARSDAAPRRELVLFDKPTRGTSIKEFREMTLSFLKANLGDLPSLPALVGQVLLMADFNKDNRVSLAEAKSVWALLQRNEFLLLLSLQEKEHASRLLGYCGDLYLTEGVPHGAWHAAALPPLLRPLLPPALQGALQQWLGPAWPWRAKIAIGLLEFVEELFHGSYGTFYMCETTLANVGYTATYDFKMADLQQVAPEATVRRFLQGRRCEHSTDCTTGATAGPRVTGS

SEQ ID NO: 30396 - protein, 419 aa, Homo sapiens
  Payload ID: 5954
  Gene Symbol: FAM69C
  Gene Name: family with sequence similarity 69, member C
  Uniprot ID: Q0P6D2
  ENSP ID: ENSP00000344331
MARAAGARGPAGWCRRRGRCGRGTLLAFAAWTAGWVLAAALLLRAHPGVLSERCTDEKSRRILAALCQDYQGGTLAGDLCEDLCVAGELLFQRCLHYNRGKKVLQADWRGRPVVLKSKEEAFSSFPPLSLLEEEAGEGGQDMPEAELLLMVAGEVKSALGLELSNSSLGPWWPGRRGPRWRGQLASLWALLQQEEYVYFSLLQDLSPHVLPVLGSCGHFYAVEFLAAGSPHHRALFPLDRAPGAPGGGQAKAISDIALSFLDMVNHFDSDFSHRLHLCDIKPENFAIRSDFTVVAIDVDMAFFEPKMREILEQNCTGDEDCNFFDCFSRCDLRVNKCGAQRVNNNLQVICDKIFRHWFSAPLKSSAVSFQLQLQLQEAVQECADPGVPSGNTRRAASSVFWKLRQLLQATLRELQEAEK

SEQ ID NO: 30397 - protein, 120 aa, Homo sapiens
  Payload ID: 5954
  Gene Symbol: FAM69C
  Gene Name: family with sequence similarity 69, member C
  Uniprot ID: Q0P6D2
  ENSP ID: ENSP00000383148
MAFFEPKMREILEQNCTGDEDCNFFDCFSRCDLRVNKCGAQRVNNNLQVICDKIFRHWFSAPLKSSAVSFQLQLQLQEAVQECADPGVPSGNTRRAASSVFWKLRQLLQATLRELQEAEK

SEQ ID NO: 30398 - protein, 594 aa, Homo sapiens
  Payload ID: 5955
  Gene Symbol: FAM71A
  Gene Name: family with sequence similarity 71, member A
  Uniprot ID: Q8IYT1
  ENSP ID: ENSP00000294829
MNADFLLPYYTAQSGSSMSMFNTTMGKLQRQLYKGEYDIFKYAPIFESDFIQITKRGEVIDVHNRVRMVTMGIARTSPILPLPDVMLLARPATGCEEYAGHGQATKRKKRKAAKNLELTRLLPLRFVRISVQDHEKQQLRLKFATGRSCYLQLCPALDTRDDLFAYWEKLIYLLRPPMESNSSTCGIPAEDMMWMPVFQEDRRSLGAVNLQGKGDQDQVSIQSLHMVSEVCGATSAAYAGGEGLQNDFNKPTNVLNASIPKTSTELAEEPATGGIKEAAAAGAAAGAATGTVAGALSVAAANSAPGQVSAAIAGAATIGAGGNKGNMALAGTASMAPNSTKVAVAGAAGKSSEHVSSASMSLSREGSVSLAIAGVVLTSRTAAEADMDAAAGPPVSTRQSKSSLSGQHGRERTQASAEGCKEGRERREKDRALGRSSHRRRTGESRHKTRGDKIAQKSSSRSSFSHRANRDDKKEKGCGNPGSSRHRDSHKGVSHTPISKESRTSHKSGRSLWTTSSGSSKGLGRVSSFLRNVRANLTTKVVGTPHGRDVNVMAKMAERSTNVAIAETAEGGQGLETVGSMTPDIMETVTFEAH

SEQ ID NO: 30399 - protein, 605 aa, Homo sapiens
  Payload ID: 5956
  Gene Symbol: FAM71B
  Gene Name: family with sequence similarity 71, member B
  Uniprot ID: Q8TC56
  ENSP ID: ENSP00000305596
MSNESCLPYYTAHSYSSMSAFKTSMGDLQRQLYNRGEYNIFKYAPMFESNFIQINKKGEVIDVHNRVRMVTVGIVCTSPILPLPDVMVLAQPTKICEQHVRWGRFAKGRGRRPVKTLELTRLLPLKFVKISIHDHEKQQLRLKLATGRTFYLQLCPSSDTREDLFCYWEKLVYLLRPPVESYCSTPTLLSGDAPPEDNKSLVAAELHREGDQSETGLYKPCDVSAATSSAYAGGEGIQHASHGTASAASPSTSTPGAAEGGAARTAGGMAVAGTATGPRTDVAIAGAAMSPATGAMSIATTKSAGPGQVTTALAGAAIKNPGENESSKSMAGAANISSEGISLALVGAASTSLEGTSTSMAGAASLSQDSSLSAAFAGSITTSKCAAERTEGPAVGPLISTLQSEGYMSERDGSQKVSQPSAEVWNENKERREKKDRHPSRKSSHHRKAGESHRRRAGDKNQKASSHRSASGHKNTRDDKKEKGYSNVRGKRHGSSRKSSTHSSTKKESRTTQELGKNQSASSTGALQKKASKISSFLRSLRATPGSKTRVTSHDREVDIVAKMVEKQNIEAKVEKAQGGQELEMISGTMTSEKTEMIVFETKSI

SEQ ID NO: 30400 - protein, 241 aa, Homo sapiens
  Payload ID: 5957
  Gene Symbol: FAM71C
  Gene Name: family with sequence similarity 71, member C
  Uniprot ID: Q8NEG0
  ENSP ID: ENSP00000315247
MEDCCMLPYYTAQSSPAMGMFNTSMGKLQRQLYKGEYTIFRYAPMFESDFIQISKRGEVIDVHNRARMVTMGIVRTSPCLTLPDVMLLARPAAVCDNARCGPATQKRESPPAEILELTRLLPLMFVKITIHNSVKKQLHLKLATGRSFYLQLCPPSDASEDLFVHWENLVYILRPPVEAYSDTRAILAGNTLDSSVLEEVQRSPVGYAMKFCEEKEQFRISRLHMNAEMFGSTYCDYTIEI

SEQ ID NO: 30401 - protein, 422 aa, Homo sapiens
  Payload ID: 5958
  Gene Symbol: FAM71D
  Gene Name: family with sequence similarity 71, member D
  Uniprot ID: Q8N9W8
  ENSP ID: ENSP00000431905
MKKNTSKTTMRINKQDALCTPHSHDPRDLQNMLDGGEYAPFVSPPMLESNFIQVNRRGESIYLHNRANWVTVGICFSSSTHKIPNVMLLAHLTPGAQKDTETLFKSLLTSPPAEKLVLTRFLPLQFVTLSVHDAENMSLKVKLVSGRAYYLQLCTSAYKQDTLFSQWVALISLLNQEKAKVSKVSEVSSLSGITNSTDITGSMDVTDVTTFTAILTPYMYAGTGPEHVRDSIDFPEFTDITDITDVTDLPENEVPEVPDVRIVTEVIEVREATEVTDSSDITNCSGVTVVFENNDLIRAKQEEKEKLKNILKPGCLQDTKSKSELKESSKHVTISNITLTFEGKRYFQTTLTPVESEANTSKEMKDKTSEEKMPDFQSTALKAEESRSLRTESNTSVLSPHIKSPSNFLKLVPHLSAPFSRE

SEQ ID NO: 30402 - protein, 400 aa, Homo sapiens
  Payload ID: 5958
  Gene Symbol: FAM71D
  Gene Name: family with sequence similarity 71, member D
  Uniprot ID: Q8N9W8
  ENSP ID: ENSP00000432195
MKKNTSKTTMRINKQDALCTPHSHDPRDLQNMLDGGEYAPFVSPPMLESNFIQVNRRGESIYLHNRANWVTVGICFSSSTHKIPNVMLLAHLTPGAQKDTETLFKSLLTSPPAEKLVLTRFLPLQFVTLSVHDAENMSLKVKLVSGRAYYLQLCTSAYKQDTLFSQWVALISLLNQEKAKVSKVSEVSSLSGITNSTDITGSMDVTDVTTFTAILTPYMYAGTGPEHVRDSIDFPEFTDITDITDVTDLPENEVPEVPDVRIVTEVIEVREATEVTDSSDITNCSGVTVVFENNDLIRAKQEEKEKLKNILKPGCLQDTKSKRYFQTTLTPVESEANTSKEMKDKTSEEKMPDFQSTALKAEESRSLRTESNTSVLSPHIKSPSNFLKLVPHLSAPFSRE

SEQ ID NO: 30403 - protein, 77 aa, Homo sapiens
  Payload ID: 5958
  Gene Symbol: FAM71D
  Gene Name: family with sequence similarity 71, member D
  ENSP ID: ENSP00000433183
MKKNTSKTTMRINKQDALCTPHSHDPRDLQNMLDGGEYAPFVSPPMLESNFIQVNRRGESIYLHNRANWVTVGICFS

SEQ ID NO: 30404 - protein, 65 aa, Homo sapiens
  Payload ID: 5958
  Gene Symbol: FAM71D
  Gene Name: family with sequence similarity 71, member D
  ENSP ID: ENSP00000436280
MKKNTSKTTMRINKQDALCTPHSHDPRDLQNMLDGGEYAPFVSPPMLESNFIQVNRRGESIYLHN

SEQ ID NO: 30405 - protein, 71 aa, Homo sapiens
  Payload ID: 5958
  Gene Symbol: FAM71D
  Gene Name: family with sequence similarity 71, member D
  ENSP ID: ENSP00000450695
  MOD_RES (1)..(1): Any amino acid
XKRYFQTTLTPVESEANTSKEMKDKTSEEKMPDFQSTALKAEESRSLRTESNTSVSPNYGLISDSLIFFPR

SEQ ID NO: 30406 - protein, 86 aa, Homo sapiens
  Payload ID: 5958
  Gene Symbol: FAM71D
  Gene Name: family with sequence similarity 71, member D
  ENSP ID: ENSP00000451865
MKKNTSKTTMRINKQDALCTPHSHDPRDLQNMLDGGEYAPFVSPPMLESNFIQPAPLRASHLNRTMIAASSRRYSSHPGGSVSWWL

SEQ ID NO: 30407 - protein, 52 aa, Homo sapiens
  Payload ID: 5958
  Gene Symbol: FAM71D
  Gene Name: family with sequence similarity 71, member D
  ENSP ID: ENSP00000451960
  MOD_RES (1)..(1): Any amino acid
XPDVRIVTEVIEVREATEVTDSSDITNCSGVTVVFENNDLIRAKQEEKELEN

SEQ ID NO: 30408 - protein, 56 aa, Homo sapiens
  Payload ID: 5958
  Gene Symbol: FAM71D
  Gene Name: family with sequence similarity 71, member D
  ENSP ID: ENSP00000454526
MKKNTSKTTMRINKQDALCTPHSHDPRDLQNMLDGGEYAPFVSPPMLESNFIQLLS

SEQ ID NO: 30409 - protein, 422 aa, Homo sapiens; identical to SEQ ID NO: 30401
  Payload ID: 5958
  Gene Symbol: FAM71D
  Gene Name: family with sequence similarity 71, member D
  Uniprot ID: Q8N9W8
  ENSP ID: ENSP00000483154

SEQ ID NO: 30410 - protein, 193 aa, Homo sapiens
  Payload ID: 5959
  Gene Symbol: FAM71E1
  Gene Name: family with sequence similarity 71, member E1
  ENSP ID: ENSP00000469375
MRRDRGPKPALGGAGEVEPGGMAASPTGRPRRLQRYLQSGEFDQFRDFPIFESNFVQVTRLGEVANEVTMGVAASSPALELPDLLLLAGPAKENGHLQLFGCGPHSRPETESSASGCGCSTACASSLLLLCPSRRSKSPKAWKPDLTPRPLNSGDSESSSILQGHRMTRDQSTLPQGRADEILKLIKVSPLRT

SEQ ID NO: 30411 - protein, 231 aa, Homo sapiens
  Payload ID: 5959
  Gene Symbol: FAM71E1
  Gene Name: family with sequence similarity 71, member E1
  Uniprot ID: Q6IPT2
  ENSP ID: ENSP00000471272
MGPPLWPDLQEPPPPGTSSQIRSPLLCDVIKPAPHHDVTVRVVPPPRFLPLLLRPLPSDGDIAMRRDRGPKPALGGAGEVEPGGMAASPTGRPRRLQRYLQSGEFDQFRDFPIFESNFVQVTRLGEVANEVTMGVAASSPALELPDLLLLAGPAKENGHLQLFGLFPLKFVQLFVHDKSRCQLEVKLNTSRTFYLQLRAPLKTRDREFGQWVRLLYRLRFLSASAVPFTQE

SEQ ID NO: 30412 - protein, 147 aa, Homo sapiens
  Payload ID: 5959
  Gene Symbol: FAM71E1
  Gene Name: family with sequence similarity 71, member E1
  ENSP ID: ENSP00000471374
PAPTSDLWPQVTRLGEVANEVTMGVAASSPALELPDLLLLAGPAKENGHLQLFGCGPHSRPETESSASGCGCSTACASSLLLLCPSRRSKSPKAWKPDLTPRPLNSGDSESSSILQGHRMTRDQSTLPQGRADEILKLIKVSPLRTN

SEQ ID NO: 30413 - protein, 247 aa, Homo sapiens
  Payload ID: 5959
  Gene Symbol: FAM71E1
  Gene Name: family with sequence similarity 71, member E1
  Uniprot ID: Q6IPT2
  ENSP ID: ENSP00000472421
MGPPLWPDLQEPPPPGTSSQIRSPLLCDVIKPAPHHDVTVRVVPPPRFLPLLLRPLPSDGDIAMRRDRGPKPALGGAGEVEPGGMAASPTGRPRRLQRYLQSGEFDQFRDFPIFESNFVQFCPDIYPAPTSDLWPQVTRLGEVANEVTMGVAASSPALELPDLLLLAGPAKENGHLQLFGLFPLKFVQLFVHDKSRCQLEVKLNTSRTFYLQLRAPLKTRDREFGQWVRLLYRLRFLSASAVPFTQE

SEQ ID NO: 30414 - protein, 168 aa, Homo sapiens
  Payload ID: 5959
  Gene Symbol: FAM71E1
  Gene Name: family with sequence similarity 71, member E1
  ENSP ID: ENSP00000472434
MRRDRGPKPALGGAGEVEPGGMAASPTGRPRRLQRYLQSGEFDQFRDFPIFESNFVQVTRLGEVANEVTMGVAASSPALELPDLLLLAGPAKENGHLQLFGLFPLKFVQLFVHDKSRCQLEVKLNTSRTFYLQLRAPLKTRDREFGQWVRLLYRLRFLSASAVPFTQE

SEQ ID NO: 30415 - protein, 922 aa, Homo sapiens
  Payload ID: 5960
  Gene Symbol: FAM71E2
  Gene Name: family with sequence similarity 71, member E2
  Uniprot ID: Q8N5Q1
  ENSP ID: ENSP00000398617
MIWLRNRRCLEPLQGTPKWVPVLGELQKTLQKGEYLPLRPLPMFESNFVQVTHQGGPVFVNHRTNRLAMGVAASLPGLVLPDILLIGQPAEDRDCSGLVLTRMIPLDLVHLCVHDLSAWRLKLRLVSGRQYYLALDAPDNEVGFLFHCWVRLINLLQEPAPTWTPRTTRTAPLDMPLAEAPASTWHLQDQPISRHAVRVAERNFPHKTVAAQRQRKAKALKRSFKSQAVGDSVPLIWSQLEHADVRKKPAEKKSHSDPRPDRTHTQIRLPEKTSITTWTIFSIISSTANQTQSSPKACTSASDEATGQGHVVESPSHCVSADSPDGFFLGSCSSLDPCLWHQDTEDLMDSGGSTLSSAASGLAPYPPAACLSTPYSSIPRGREKAGPMGSHQGPGPPPCQKAPSGLVTSCKAPFLVDQSQKLPAVPASSWKPPPGLAPPQKAPAASAPPRKAPAVPAPSQKAPAVPAPSQKAPAIPAPSRKASAASASPRKASAVPAPPQKTPPPSQKAPSVPTIPQKAVSPTAPKKKSLLLPAPSQKALPTSPTEYQMALSPPASRGKLPGDFDVLPTGIPGRAVLERSQSGGKPEPVVTVRTQETDVVEMTTQAKSPESPFTVTKKESKDILISQTKEVTLEAFRGQGKLEDWAHWAKLEERSPDLPGVRSKELEQRKRWVKAKELAVEGPSQEHSRPFSVEALTLTKLMITANSKEQPSKSALVSLPSWLLATPQASATSMMASVPSRPGQLSLLEGKPVVVREQPESHTWVKEGKRPWGEMKEQPWGEMKEPPWDPKGPPKVPFRSKPTSASLKREGISQAPIPLTASPWEDLRPSPLSETLISKMEATARASQQPKRVSQEPMRMPAQHPLATVGSSSEILLPMLLELETVRNTATKAEEIQEESGVLNLLPSLQHSQHSEWPDAGA

SEQ ID NO: 30416 - protein, 63 aa, Homo sapiens
  Payload ID: 5960
  Gene Symbol: FAM71E2
  Gene Name: family with sequence similarity 71, member E2
  ENSP ID: ENSP00000466418
MIWLRNRRCLEPLQGTPKWVPVLGELQKTLQKGDPSRGPSVRESQNQPAGHGRGRLPARPGVA

SEQ ID NO: 30417 - protein, 344 aa, Homo sapiens
  Payload ID: 5961
  Gene Symbol: FAM71F1
  Gene Name: family with sequence similarity 71, member F1
  Uniprot ID: Q96KD3
  ENSP ID: ENSP00000326652
MLSSFPHRKTWRKSKKTVKVTRSYPTFPSLNAWEEFRGLLPVDGEPNPGAGLGVEEGLLCRVVHSPEFNLFLDSVVFESNFIQVKRGRNWRDVYKASNTMALGVTSSVPCLPLPNILLMASVKWHQGQNQTWNRPSIAPNIFLKRILPLRFVELQVCDHYQRILQLRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLSFRSSRKVETNKNSSGKDSSREDSIPCTCDLRWRASFTYGEWERENPSGLQPLSLLSTLAASTGPQLAPPIGNSI

SEQ ID NO: 30418 - protein, 134 aa, Homo sapiens
  Payload ID: 5961
  Gene Symbol: FAM71F1
  Gene Name: family with sequence similarity 71, member F1
  ENSP ID: ENSP00000417930
RILPLRFVELQVCDHYQRILQLRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLSFRSSRKVE

SEQ ID NO: 30419 - protein, 243 aa, Homo sapiens
  Payload ID: 5961
  Gene Symbol: FAM71F1
  Gene Name: family with sequence similarity 71, member F1
  Uniprot ID: Q96KD3
  ENSP ID: ENSP00000418192
MELDGQKGQELERRLQSFQHHGPGGDLLGTLPAPPQHPTHGQCQMAPGAEPDMEQTIHSPQHLPEELRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLRSSRKVETNKNSSGKDSSREDSIPCTCDLRWRASFTYGEWERENPSGLQPLSLLSTLAASTGPQLAPPIGNSI

SEQ ID NO: 30420 - protein, 143 aa, Homo sapiens
  Payload ID: 5961
  Gene Symbol: FAM71F1
  Gene Name: family with sequence similarity 71, member F1
  ENSP ID: ENSP00000418591
MAPGAEPDMEQTIHSPQHLPEELRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLRNQLDQQFRGRTNSLSF

SEQ ID NO: 30421 - protein, 286 aa, Homo sapiens
  Payload ID: 5961
  Gene Symbol: FAM71F1
  Gene Name: family with sequence similarity 71, member F1
  ENSP ID: ENSP00000418672
MLSSFPHRKTWRKSKKTVKVTRSYPTFPSLNAWEEFRGLLPVDGEPNPGAGLGVEEGLLCRVVHSPEFNLFLDSVVFESNFIQVKRGRNWRDVYKASNTMALGVTSSVPCLPLPNILLMASVKWHQGQNQTWNRPSIAPNIFLKRILPLRFVELQVCDHYQRILQLRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLRNQLDQQFRGRTNSLSF

SEQ ID NO: 30422 - protein, 243 aa, Homo sapiens; identical to SEQ ID NO: 30419
  Payload ID: 5961
  Gene Symbol: FAM71F1
  Gene Name: family with sequence similarity 71, member F1
  Uniprot ID: Q96KD3
  ENSP ID: ENSP00000477573

SEQ ID NO: 30423 - protein, 300 aa, Homo sapiens
  Payload ID: 5962
  Gene Symbol: FAM71F2
  Gene Name: family with sequence similarity 71, member F2
  Uniprot ID: Q6NXP2
  ENSP ID: ENSP00000401654
MSKIRGLPPEVREPGPGVELGVENGLLCQLIHSPEFNLFSNSVVFESNFIQVTKPGNWRDVCEGSATVILGVTSSVPSLPLPNVLLMANVTWPQGPFTTWSTPGDAPVINLSRLLPLKYVELRIYDRLQRILRVRTVTEKIYYLKLHEKHPEIVFQFWVRLVKILQKGLSITTKDPRIKFTHCLVPKMPTNSTETTPENSLLSSPQPSEPLVLLAAEQTSGSFSQLSGKPQLTADRNNDTAIEIDNCSSYKIPSPVASPINLNIPMRAALSHSLWEQEDWNEHLLQVHIASYLGEHFLGA

SEQ ID NO: 30424 - protein, 300 aa, Homo sapiens; identical to SEQ ID NO: 30423
  Payload ID: 5962
  Gene Symbol: FAM71F2
  Gene Name: family with sequence similarity 71, member F2
  Uniprot ID: Q6NXP2
  ENSP ID: ENSP00000418907

SEQ ID NO: 30425 - protein, 169 aa, Homo sapiens
  Payload ID: 5962
  Gene Symbol: FAM71F2
  Gene Name: family with sequence similarity 71, member F2
  ENSP ID: ENSP00000419649
MSKIRGLPPEVREPGPGVELGVENGLLCQLIHSPEFNLFSNSVVFESNFIQTHVPEADFQVTKPGNWRDVCEGSATVILGVTSSVPSLPLPNVLLMANVTWPQGPFTTWSTPGDAPVINLSSLKTASCHPPSPASPSCCWRLSRPVAVSHSSQESPSSQQTGTMTLPLK

SEQ ID NO: 30426 - protein, 309 aa, Homo sapiens
  Payload ID: 5962
  Gene Symbol: FAM71F2
  Gene Name: family with sequence similarity 71, member F2
  Uniprot ID: Q6NXP2
  ENSP ID: ENSP00000420140
MSKIRGLPPEVREPGPGVELGVENGLLCQLIHSPEFNLFSNSVVFESNFIQTHVPEADFQVTKPGNWRDVCEGSATVILGVTSSVPSLPLPNVLLMANVTWPQGPFTTWSTPGDAPVINLSRLLPLKYVELRIYDRLQRILRVRTVTEKIYYLKLHEKHPEIVFQFWVRLVKILQKGLSITTKDPRIKFTHCLVPKMPTNSTETTPENSLLSSPQPSEPLVLLAAEQTSGSFSQLSGKPQLTADRNNDTAIEIDNCSSYKIPSPVASPINLNIPMRAALSHSLWEQEDWNEHLLQVHIASYLGEHFLGA

SEQ ID NO: 30427 - protein, 109 aa, Homo sapiens
  Payload ID: 5963
  Gene Symbol: FAM72A
  Gene Name: family with sequence similarity 72, member A
  Uniprot ID: Q5TYM5
  ENSP ID: ENSP00000340661
MSTNICSFKDSAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 30428 - protein, 149 aa, Homo sapiens
  Payload ID: 5963
  Gene Symbol: FAM72A
  Gene Name: family with sequence similarity 72, member A
  Uniprot ID: Q5TYM5
  ENSP ID: ENSP00000356096
MSTNICSFKDRCVSILCCKFCKQVLSSRGMKAVLLADTEIDLFSTDIPPTNAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 30429 - protein, 149 aa, Homo sapiens
  Payload ID: 5963
  Gene Symbol: FAM72A
  Gene Name: family with sequence similarity 72, member A
  ENSP ID: ENSP00000356097
MPTTTALRWTAAARVRRKGRGGWVPAALRSVSQDGVPGCTVMGGETRSPENAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 30430 - protein, 120 aa, Homo sapiens
  Payload ID: 5963
  Gene Symbol: FAM72A
  Gene Name: family with sequence similarity 72, member A
  ENSP ID: ENSP00000475292
MKAVLLADTEIDLFSTDIPPTNAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 30431 - protein, 51 aa, Homo sapiens
  Payload ID: 5963
  Gene Symbol: FAM72A
  Gene Name: family with sequence similarity 72, member A
  ENSP ID: ENSP00000475410
MSTNICSFKDRCVSILCCKFCKQVLSSRGMKAVLLADTEIDLFSTDIPPTK

SEQ ID NO: 30432 - protein, 70 aa, Homo sapiens
  Payload ID: 5963
  Gene Symbol: FAM72A
  Gene Name: family with sequence similarity 72, member A
  ENSP ID: ENSP00000476019
MPTTTALRWTAAARVRRKGRGGWVPAALRSVSQDGVPGCTVMGGETRSPEKSVPQSLEEPPPTPQDPAGK

SEQ ID NO: 30433 - protein, 109 aa, Homo sapiens
  Payload ID: 5964
  Gene Symbol: FAM72B
  Gene Name: family with sequence similarity 72, member B
  Uniprot ID: Q86X60
  ENSP ID: ENSP00000347368
MSTNICSFKDSAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 30434 - protein, 149 aa, Homo sapiens
  Payload ID: 5964
  Gene Symbol: FAM72B
  Gene Name: family with sequence similarity 72, member B
  Uniprot ID: Q86X60
  ENSP ID: ENSP00000358397
MSTNICSFKDRCVSILCCKFCKQVLSSRGMKAVLLADTEIDLFSTDIPPTNAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 30435 - protein, 120 aa, Homo sapiens
  Payload ID: 5964
  Gene Symbol: FAM72B
  Gene Name: family with sequence similarity 72, member B
  ENSP ID: ENSP00000392882
MKAVLLADTEIDLFSTDIPPTNAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 30436 - protein, 94 aa, Homo sapiens
  Payload ID: 5964
  Gene Symbol: FAM72B
  Gene Name: family with sequence similarity 72, member B
  ENSP ID: ENSP00000482799
MSTNICSFKDRCVSILCCKFCKQVLSSRGMKAVLLADTEIDLFSTDIPPTNAVDFTGRCYFTKICKCKLKDIACLKWCKHPTLGQLARDRREYR

SEQ ID NO: 30437 - protein, 149 aa, Homo sapiens
  Payload ID: 5964
  Gene Symbol: FAM72B
  Gene Name: family with sequence similarity 72, member B
  ENSP ID: ENSP00000484557
MPTTTALRWTAAARVRRKGRGGWVLAALRSVSQDGVPGCTVMGGETRSPENAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 30438 - protein, 94 aa, Homo sapiens
  Payload ID: 5965
  Gene Symbol: FAM72C
  Gene Name: family with sequence similarity 72, member C
  ENSP ID: ENSP00000358174
MSTNICSFKDRCVSILCCKFCKQVLSSRGMKAVLLADTEIDLFSTDIPPTNAVDFTGRCYFTKICKCKLKDIACLKWCKRPTSGQLARDRREYR

SEQ ID NO: 30439 - protein, 149 aa, Homo sapiens
  Payload ID: 5965
  Gene Symbol: FAM72C
  Gene Name: family with sequence similarity 72, member C
  Uniprot ID: H0Y354
  ENSP ID: ENSP00000463032
MSTNICSFKDRCVSILCCKFCKQVLSSRGMKAVLLADTEIDLFSTDIPPTNAVDFTGRCYFTKICKCKLKDIACLKCGNIVVYHVIVPCSSCLLSCNNRHFWMFHSQAVYDINRLDSTGVNVLLRGNLPEIEESTDEDVLNISAEECIR

SEQ ID NO: 30440 - protein, 149 aa, Homo sapiens
  Payload ID: 5966
  Gene Symbol: FAM72D
  Gene Name: family with sequence similarity 72, member D
  Uniprot ID: Q6L9T8
  ENSP ID: ENSP00000383682
MSTNICSFKDRCVSILCCKFCKQVLSSRGMKAVLLADTEIDLFSTDIPPTNAVDFTGRCYFTKICKCKLKDIACLKCGNIVGYHVIVPCSSCLLSCNNRHFWMFHSQAVYDINRLDSTGVNVLLRGNLPEIEESTDEDVLNISAEECIR

SEQ ID NO: 30441 - protein, 632 aa, Homo sapiens
  Payload ID: 5967
  Gene Symbol: FAM73A
  Gene Name: family with sequence similarity 73, member A
  Uniprot ID: Q8NAN2
  ENSP ID: ENSP00000359827
MSDCCSAPGISWEAGVGRPAVPGLELQIRRGAMSEETVSESQFSLKTAALRVFDLPLTWYYSLSQIKFSPVAKKLFVVTAVSAISVIFLAHHFKRKRGKKKGKILPWEPEHLILEYTKRAASDKGSSCSSSRQNLTLSLSSTKDKGSQVCNYANGGLFSKYSGSAQSLASVQSVNSCHSCACGNSNSWDKADEDDIKLVNIPVTTPENLYLMGMELFEEALRRWEQALTFRNRQAEDEACGSIKLGAGDAIAEENVDDIISTEFIHKLEALLQRAYRLQEEFEATLGASDPNSLADDIDKDTDITMKGNVEDFGLRDTLSIASTDSFASAAELAEHREVRHTYSLESLCHCPFYEEAMHLVEEGKIYSRVLRTEMLECLGDSDFLAKLHCIRQAFQVILSESANRIFLAESGRKILSALIVKARKNPKKFEDVFDEMIYFLEQTDHWGSTEMELAARGVKNLNFYDVVLDFILMDSFEDLENPPTSIQNVVNNRWLNSSFKETAVASSCWSVLKQKRQQMKIPDGFFAHFYAICEHISPVLAWGFLGPRNSLYDLCCFFKNQVLLFLKDIFDFEKVRYSSTETLAEDLMQLLIRRTELLMAYLEADALRHTSSCLSSHGHVMSTGLLEAKVQ

SEQ ID NO: 30442 - protein, 633 aa, Homo sapiens
  Payload ID: 5967
  Gene Symbol: FAM73A
  Gene Name: family with sequence similarity 73, member A
  ENSP ID: ENSP00000393675
MSDCCSAPGISWEAGVGRPAVPGLELQIRRGAMSEETVSESQFSLKTAALRVFDLPLTWYYSLSQIKFSPVAKKLFVVTAVSAISVIFLAHHFKRKRGKKKGKILPWEPEHLILEYTKRAASDKGSSCSSSRQNLTLSLSSTKDKGSQVCNYANGGLFSKYSGSAQSLASVQSVNSCHSCACGNSNSWDKADEDDIKLVNIPVTTPENLYLMGMELFEEALRRWEQALTFRNRQAEDEACGSIKLGAGDAIAEENVDDIISTEFIHKLEALLQRAYRLQEEFEATLGASDPNSLADDIDKDTDITMKGNVEDFGLRDTLSIASTDSFASAAELAEHREVRHTYSLESLCHCPFYEEAMHLVEEGKIYSRVLRTEMLECLGDSDFLAKLHCIRQAFQVILSESANRIFLAESGRKILSALIVKARKNPKKFEDVFDEMIYFLEQTDHWGSTEMELAARGVKNLNFYDVVLDFILMDSFEDLENPPTSIQNVVNNRWLNSSFKETAVASSCWSVLKQKRQQMKQIPDGFFAHFYAICEHISPVLAWGFLGPRNSLYDLCCFFKNQVLLFLKDIFDFEKVRYSSTETLAEDLMQLLIRRTELLMAYLEADALRHTSSCLSSHGHVMSTGLLEAKVQ

SEQ ID NO: 30443 - protein, 66 aa, Homo sapiens
  Payload ID: 5967
  Gene Symbol: FAM73A
  Gene Name: family with sequence similarity 73, member A
  ENSP ID: ENSP00000473285
MSEETVSESQFSLKTAALRVFDLPLTWYYSLSQIKFSPVAKKLFVVTAVSAISVIFLAHHFKRKRG

SEQ ID NO: 30444 - protein, 593 aa, Homo sapiens
  Payload ID: 5968
  Gene Symbol: FAM73B
  Gene Name: family with sequence similarity 73, member B
  Uniprot ID: Q7L4E1
  ENSP ID: ENSP00000351138
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRTELLGCYSDQDFLAKLHCVRQAFEGLLEDKSNQLFFGKVGRQMVTGLMTKAEKSPKGFLESYEEMLSYALRPETWATTRLELEGRGVVCMSFFDIVLDFILMDAFEDLENPPASVLAVLRNRWLSDSFKETALATACWSVLKAKRRLLMVPDGFISHFYSVSEHVSPVLAFGFLGPKPQLAEVCAFFKHQIVQYLRDMFDLDNVRYTSLPALADDILQLSRRRSEILLGYLGVPAASSAGVNGALPRENGPLGELQ

SEQ ID NO: 30445 - protein, 323 aa, Homo sapiens
  Payload ID: 5968
  Gene Symbol: FAM73B
  Gene Name: family with sequence similarity 73, member B
  Uniprot ID: Q7L4E1
  ENSP ID: ENSP00000391603
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSETESHSVARLECSGAISAQCNLRFLGSRDSPASASQVAGITARVTAEGVCREAGVPAAPCLPPAGGVRLHLPRRQHAARPREDPHAAPDRGLAAAAGGR

SEQ ID NO: 30446 - protein, 349 aa, Homo sapiens
  Payload ID: 5968
  Gene Symbol: FAM73B
  Gene Name: family with sequence similarity 73, member B
  Uniprot ID: Q7L4E1
  ENSP ID: ENSP00000396618
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRAPKASWRATRRC

SEQ ID NO: 30447 - protein, 99 aa, Homo sapiens
  Payload ID: 5968
  Gene Symbol: FAM73B
  Gene Name: family with sequence similarity 73, member B
  ENSP ID: ENSP00000409348
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPS

SEQ ID NO: 30448 - protein, 143 aa, Homo sapiens
  Payload ID: 5968
  Gene Symbol: FAM73B
  Gene Name: family with sequence similarity 73, member B
  ENSP ID: ENSP00000415906
KLHCVRQAFEGLLEDKSNQLFFGKVGRQMVTGLMTKAEKSPKGFLESYEEMLSYALRPETWATTRLELEGRGSPVPALPQAKAEGGMASATPVAQQSGKDVSPPRVLMPWTPASVSPSGKWPRGSGSAPMHEPPGGTLCRWYA

SEQ ID NO: 30449 - protein, 341 aa, Homo sapiens
  Payload ID: 5969
  Gene Symbol: FAM76A
  Gene Name: family with sequence similarity 76, member A
  Uniprot ID: Q8TAV0
  ENSP ID: ENSP00000010299
MAALYACTKCHQRFPFEALSQGQQLCKECRIAHPVVKCTYCRTEYQQERLECNGTISAHCNLHLPGSSDSPASSSRVAGITGIKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSQKTLSTSSIQNEIPKKKSKFESITTNGDSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 30450 - protein, 312 aa, Homo sapiens
  Payload ID: 5969
  Gene Symbol: FAM76A
  Gene Name: family with sequence similarity 76, member A
  Uniprot ID: Q8TAV0
  ENSP ID: ENSP00000234549
MAALYACTKCHQRFPFEALSQGQQLCKECRIAHPVVKCTYCRTEYQQERLECNGTISAHCNLHLPGSSDSPASSSRVAGITGIKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 30451 - protein, 278 aa, Homo sapiens
  Payload ID: 5969
  Gene Symbol: FAM76A
  Gene Name: family with sequence similarity 76, member A
  Uniprot ID: Q8TAV0
  ENSP ID: ENSP00000363060
MAALYACTKCHQRFPFEALSQGQQLCKECRIAHPVVKCTYCRTEYQQESKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 30452 - protein, 307 aa, Homo sapiens
  Payload ID: 5969
  Gene Symbol: FAM76A
  Gene Name: family with sequence similarity 76, member A
  Uniprot ID: Q8TAV0
  ENSP ID: ENSP00000363065
MAALYACTKCHQRFPFEALSQGQQLCKECRIAHPVVKCTYCRTEYQQESKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSQKTLSTSSIQNEIPKKKSKFESITTNGDSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 30453 - protein, 124 aa, Homo sapiens
  Payload ID: 5969
  Gene Symbol: FAM76A
  Gene Name: family with sequence similarity 76, member A
  ENSP ID: ENSP00000393171
QYSRLSGGGHYNSFSPDLALDSPGTDHFVIIAQLKEEVATLKKMLHQKDQMILEKEKKITELKADFQYQESQMRAKMNQMEKTHKEVTEQLQRWALAILPGLVLNSWLQAILPPQPHKVLGLQA

SEQ ID NO: 30454 - protein, 227 aa, Homo sapiens
  Payload ID: 5969
  Gene Symbol: FAM76A
  Gene Name: family with sequence similarity 76, member A
  Uniprot ID: Q8TAV0
  ENSP ID: ENSP00000395150
MAALYACTKCHQRFPFEALSQGQQLCKECRIAHPVVKCTYCRTEYQQESKTNTICKKCAQNVQLYGTVDGKLLCWLCTLSYKRVLQKTKEQRKHLSSSSRAGHQEKEQYSRLSGGGHYNSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 30455 - protein, 288 aa, Homo sapiens
  Payload ID: 5969
  Gene Symbol: FAM76A
  Gene Name: family with sequence similarity 76, member A
  ENSP ID: ENSP00000436176
MAALYACTKCHQRFPFEALSQGQQLCKECRIAHPVVKCTYCRTEYQQESKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSQKTLSTSSIQNEIPKKKSKFESITTNGDSFSPDLALDSPGTDHFVIIAQLKEEVATLKKMLHQKDQMILEKEKKITELKADFQYQESQMRAKMNQMEKTHKEVTEQLQVTDSAYFMC

SEQ ID NO: 30456 - protein, 339 aa, Homo sapiens
  Payload ID: 5970
  Gene Symbol: FAM76B
  Gene Name: family with sequence similarity 76, member B
  Uniprot ID: Q5HYJ3
  ENSP ID: ENSP00000351631
MAASALYACTKCTQRYPFEELSQGQQLCKECRIAHPIVKCTYCRSEFQQESKTNTICKKCAQNVKQFGTPKPCQYCNIIAAFIGTKCQRCTNSEKKYGPPQTCEQCKQQCAFDRKEEGRRKVDGKLLCWLCTLSYKRVLQKTKEQRKSLGSSHSNSSSSSLTEKDQHHPKHHHHHHHHHHRHSSSHHKISNLSPEEEQGLWKQSHKSSATIQNETPKKKPKLESKPSNGDSSSINQSADSGGTDNFVLISQLKEEVMSLKRLLQQRDQTILEKDKKLTELKADFQYQESNLRTKMNSMEKAHKETVEQLQAKNRELLKQVAALSKGKKFDKSGSILTSP

SEQ ID NO: 30457 - protein, 233 aa, Homo sapiens
  Payload ID: 5970
  Gene Symbol: FAM76B
  Gene Name: family with sequence similarity 76, member B
  Uniprot ID: Q5HYJ3
  ENSP ID: ENSP00000381248
MAASALYACTKCTQRYPFEELSQGQQLCKECRIAHPIVKCTYCRSEFQQESKTNTICKKCAQNVKQFGTPKPCQYCNIIAAFIGTKCQRCTNSEKKYGPPQTCEQCKQQCAFDRKEEGRRKVDGKLLCWLCTLSYKRVLQKTKEQRKSLGSSHSNSSSSSLTEKDQHHPKHHHHHHHHHHRHSSSHHKISNLSPEEEQGLWKQSHKSSATIQNETPKKKPKLESKPSNGDRCM

SEQ ID NO: 30458 - protein, 47 aa, Homo sapiens
  Payload ID: 5970
  Gene Symbol: FAM76B
  Gene Name: family with sequence similarity 76, member B
  ENSP ID: ENSP00000437366
MDHLRPVNSANSNVLLIGRRKEEERLMESYYAGSVLYRTKEFYRRRK

SEQ ID NO: 30459 - protein, 338 aa, Homo sapiens
  Payload ID: 5970
  Gene Symbol: FAM76B
  Gene Name: family with sequence similarity 76, member B
  ENSP ID: ENSP00000441168
MAASALYACTKCTQRYPFEELSQGQQLCKECRIAHPIVKCTYCRSEFQQESKTNTICKKCAQNVKQFGTPKPCQYCNIIAAFIGTKCQRCTNSEKKYGPPQTCEQCKQQCAFDRKEEGRRKVDGKLLCWLCTLSYKRVLQKTKEQRKSLGSSHSNSSSSSLTEKDQHHPKHHHHHHHHHHRHSSSHHKISNLSPEEEQGLWKQSHKSSATIQNETPKKKPKLESKPSNGDSSINQSADSGGTDNFVLISQLKEEVMSLKRLLQQRDQTILEKDKKLTELKADFQYQESNLRTKMNSMEKAHKETVEQLQAKNRELLKQVAALSKGKKFDKSGSILTSP

SEQ ID NO: 30460 - protein, 91 aa, Homo sapiens
  Payload ID: 5970
  Gene Symbol: FAM76B
  Gene Name: family with sequence similarity 76, member B
  ENSP ID: ENSP00000442652
MDHLRPVNSANSNVLLIGRRKEEERLMESYYAGSVLYRTKEFYRRRKNKGRAWDLHIQIHLLHLLLRKTSIIQNIITTIITITIVTAVAIT

SEQ ID NO: 30461 - protein, 49 aa, Homo sapiens
  Payload ID: 5970
  Gene Symbol: FAM76B
  Gene Name: family with sequence similarity 76, member B
  ENSP ID: ENSP00000443440
MAASALYACTKCTQRYPFEELSQGQQLCKESEATGLGTECSDLELLPSH

SEQ ID NO: 30462 - protein, 233 aa, Homo sapiens; identical to SEQ ID NO: 30457
  Payload ID: 5970
  Gene Symbol: FAM76B
  Gene Name: family with sequence similarity 76, member B
  Uniprot ID: Q5HYJ3
  ENSP ID: ENSP00000444087

SEQ ID NO: 30463 - protein, 91 aa, Homo sapiens; identical to SEQ ID NO: 30460
  Payload ID: 5970
  Gene Symbol: FAM76B
  Gene Name: family with sequence similarity 76, member B
  ENSP ID: ENSP00000445612

SEQ ID NO: 30464 - protein, 280 aa, Homo sapiens
  Payload ID: 5971
  Gene Symbol: FAM78A
  Gene Name: family with sequence similarity 78, member A
  ENSP ID: ENSP00000361343
MTSYILISFVLLIGVGCIEKDQSCPVFGGRKRLHLLFVGGQLRQVRMLRGSPEASTDCCWLHQATGSGSVTQAGVQWYDLGSLQPLPPRFKRFSCLSLPSSWDYRSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 30465 - protein, 283 aa, Homo sapiens
  Payload ID: 5971
  Gene Symbol: FAM78A
  Gene Name: family with sequence similarity 78, member A
  Uniprot ID: Q5JUQ0
  ENSP ID: ENSP00000361345
MPGFFCDCWPSLEIRALLYAMGCIQSIGGKARVFREGITVIDVKASIDPVPTSIDESSSVVLRYRTPHFRASAQVVMPPIPKKETWVVGWIQACSHMEFYNQYGEQGMSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 30466 - protein, 252 aa, Homo sapiens
  Payload ID: 5971
  Gene Symbol: FAM78A
  Gene Name: family with sequence similarity 78, member A
  ENSP ID: ENSP00000419959
GQGIAAALIHLPSTGNKHWRPRSPEASTDCCWLHQATGSGSVTQAGVQWYDLGSLQPLPPRFKRFSCLSLPSSWDYRSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 30467 - protein, 261 aa, Homo sapiens
  Payload ID: 5972
  Gene Symbol: FAM78B
  Gene Name: family with sequence similarity 78, member B
  Uniprot ID: Q5VT40
  ENSP ID: ENSP00000339681
MGCIQSITCKARIRRENIVVYDVCATIDQCPTRIEETSPIVLRYKTPYFKASARVVMPPIPRHETWVVGWIQACNQMEFFNTYSDLGMSSWELPDLREGRVKAISDSDGVSYPWYGNTTETVTLVGPTNKISRFSVSMNDNFYPSVTWAVPVSDSNVPLLTRIKRDQSFTTWLVAMNTTTKEKIILQTIKWRMRVDIEVDPLQLLGQRARLVGRTQQEQPRILSRMEPIPPNALVKPNANDAQVLMWRPKRGPPLVVIPPK

SEQ ID NO: 30468 - protein, 261 aa, Homo sapiens; identical to SEQ ID NO: 30467
  Payload ID: 5972
  Gene Symbol: FAM78B
  Gene Name: family with sequence similarity 78, member B
  Uniprot ID: Q5VT40
  ENSP ID: ENSP00000346404

SEQ ID NO: 30469 - protein, 261 aa, Homo sapiens; identical to SEQ ID NO: 30467
  Payload ID: 5972
  Gene Symbol: FAM78B
  Gene Name: family with sequence similarity 78, member B
  Uniprot ID: Q5VT40
  ENSP ID: ENSP00000389945

SEQ ID NO: 30470 - protein, 257 aa, Homo sapiens
  Payload ID: 5972
  Gene Symbol: FAM78B
  Gene Name: family with sequence similarity 78, member B
  ENSP ID: ENSP00000393329
  MOD_RES (1)..(1): Any amino acid
XSITCKARIRRENIVVYDVCATIDQCPTRIEETSPIVLRYKTPYFKASARVVMPPIPRHETWVVGWIQACNQMEFFNTYSDLGMSSWELPDLREGRVKAISDSDGVSYPWYGNTTETVTLVGPTNKISRFSVSMNDNFYPSVTWAVPVSDSNVPLLTRIKRDQSFTTWLVAMNTTTKEKIILQTIKWRMRVDIEVDPLQLLGQRARLVGRTQQEQPRILSRMEPIPPNALVKPNANDAQVLMWRPKRGPPLVVIPPK

SEQ ID NO: 30471 - protein, 254 aa, Homo sapiens
  Payload ID: 5972
  Gene Symbol: FAM78B
  Gene Name: family with sequence similarity 78, member B
  ENSP ID: ENSP00000412766
  MOD_RES (1)..(1): Any amino acid
XCKARIRRENIVVYDVCATIDQCPTRIEETSPIVLRYKTPYFKASARVVMPPIPRHETWVVGWIQACNQMEFFNTYSDLGMSSWELPDLREGRVKAISDSDGVSYPWYGNTTETVTLVGPTNKISRFSVSMNDNFYPSVTWAVPVSDSNVPLLTRIKRDQSFTTWLVAMNTTTKEKIILQTIKWRMRVDIEVDPLQLLGQRARLVGRTQQEQPRILSRMEPIPPNALVKPNANDAQVLMWRPKRGPPLVVIPPK

SEQ ID NO: 30472 - protein, 413 aa, Homo sapiens
  Payload ID: 5973
  Gene Symbol: FAM8A1
  Gene Name: family with sequence similarity 8, member A1
  Uniprot ID: Q9UBU6
  ENSP ID: ENSP00000259963
MAEGPEEARGHPPGQDDGGGDHEPVPSLRGPPTTAVPCPRDDPQAEPQAPGRPTAPGLAAAAAADKLEPPRELRKRGEAASGSGAELQEQAGCEAPEAAAPRERPARLSAREYSRQVHEWLWQSYCGYLTWHSGLAAFPAYCSPQPSPQSFPSGGAAVPQAAAPPPPQLGYYNPFYFLSPGAAGPDPRTAAGISTPAPVAGLGPRAPHVQASVRATPVTRVGSAAPSRSPSETGRQAGREYVIPSLAHRFMAEMVDFFILFFIKATIVLSIMHLSGIKDISKFAMHYIIEEIDEDTSMEDLQKMMVVALIYRLLVCFYEIICIWGAGGATPGKFLLGLRVVTCDTSVLIAPSRVLVIPSSNVSITTSTIRALIKNFSIASFFPAFITLLFFQHNRTAYDIVAGTIVVKRNGVR

SEQ ID NO: 30473 - protein, 368 aa, Homo sapiens
  Payload ID: 5974
  Gene Symbol: FAM81A
  Gene Name: family with sequence similarity 81, member A
  Uniprot ID: Q8TBF8
  ENSP ID: ENSP00000288228
MENMHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSALKTLEMRQLSGLGDLRGRVARCDASIARLSAEHKTTYEGLQHLNKEQQAAKLILETKIKDAEGQISQLLNRVDLSISEQSTKLKMSHRDSNHQLQLLDTKFKGTVEELSNQILSARSWLQQEQERIEKELLQKIDQLSLIVKENSGASERDMEKKLSQMSARLDKIEEGQKKTFDGQRTRQEEEKMHGRITKLELQMNQNIKEMKAEVNAGFTAVYESIGSLRQVLEAKMKLDRDQLQKQIQLMQKPETPM

SEQ ID NO: 30474 - protein, 146 aa, Homo sapiens
  Payload ID: 5974
  Gene Symbol: FAM81A
  Gene Name: family with sequence similarity 81, member A
  ENSP ID: ENSP00000452853
MAQRSTVFPSRVTKERRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSALKTLEMRQLSGLGDLRGRVA

SEQ ID NO: 30475 - protein, 68 aa, Homo sapiens
  Payload ID: 5974
  Gene Symbol: FAM81A
  Gene Name: family with sequence similarity 81, member A
  ENSP ID: ENSP00000452902
MENMHLRRVRTMPRHSQSLTMAPYSSVSLVEQLEDRILCHEKTTAALVEHAFRIKDDIVNSLQKMQNK

SEQ ID NO: 30476 - protein, 133 aa, Homo sapiens
  Payload ID: 5974
  Gene Symbol: FAM81A
  Gene Name: family with sequence similarity 81, member A
  ENSP ID: ENSP00000452962
MENMHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSALKTLEMRQLSGLGDLR

SEQ ID NO: 30477 - protein, 126 aa, Homo sapiens
  Payload ID: 5974
  Gene Symbol: FAM81A
  Gene Name: family with sequence similarity 81, member A
  ENSP ID: ENSP00000453296
MAQRSTVFPSRVTKERRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSA

SEQ ID NO: 30478 - protein, 67 aa, Homo sapiens
  Payload ID: 5974
  Gene Symbol: FAM81A
  Gene Name: family with sequence similarity 81, member A
  ENSP ID: ENSP00000453582
MENMHLRRVRTMPRHSQSLTMAPYSSVSLVEQLEDRILCHEKTTAALVEHAFRIKDDIVNSLQKMQN

SEQ ID NO: 30479 - protein, 115 aa, Homo sapiens
  Payload ID: 5974
  Gene Symbol: FAM81A
  Gene Name: family with sequence similarity 81, member A
  ENSP ID: ENSP00000453769
MENMHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTN

SEQ ID NO: 30480 - protein, 58 aa, Homo sapiens
  Payload ID: 5974
  Gene Symbol: FAM81A
  Gene Name: family with sequence similarity 81, member A
  ENSP ID: ENSP00000453784
MENMHLRRVRTMPRHSQSLTMAPYSSVSLVEQLEDRILCHEKTTAALVEHAFRIKDDI

SEQ ID NO: 30481 - protein, 115 aa, Homo sapiens; identical to SEQ ID NO: 30479
  Payload ID: 5974
  Gene Symbol: FAM81A
  Gene Name: family with sequence similarity 81, member A
  ENSP ID: ENSP00000453864

SEQ ID NO: 30482 - protein, 108 aa, Homo sapiens
  Payload ID: 5974
  Gene Symbol: FAM81A
  Gene Name: family with sequence similarity 81, member A
  ENSP ID: ENSP00000453918
MENMHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARD

SEQ ID NO: 30483 - protein, 452 aa, Homo sapiens
  Payload ID: 5975
  Gene Symbol: FAM81B
  Gene Name: family with sequence similarity 81, member B
  Uniprot ID: Q96LP2
  ENSP ID: ENSP00000283357
MQLQFLGTLASSEKRKKSQRLFFKNIKSTKNKAGKASIMSSDTNVNKSASPTATAEEQPVEPDGPLPGSDNNQEKKVRLSPAKMSTKNSTDLVEYVDKSHAFLPIIPNTQRGQLEDRLNNQARTIAFLLEQAFRIKEDISACLQGTHGFRKEESLARKLLESHIQTITSIVKKLSQNIEILEDQIRARDQAATGTNFAVHEINIKHLQGVGDLRGRVARCDSSIVKLSGDIHLFRQEHRQIEKAIQEFVPALETLSKNLDMKVMQLLGKIETASSEQTSNLKMVQGDYRHEMNLLEFKFHSLSSNLYEEVENNKKWTENQFLKYRKDHLGHINECLKVLQEKLEKSENKMEEKLLQLSSKVENFINTQKQETQLSKVKHMENKLSKKMEQMEKQIWGELETMQNEYQSGFKSIHDSLSSLQQIQKTKMDLEKYKVQKDLKKLQRKIVELQEV

SEQ ID NO: 30484 - protein, 127 aa, Homo sapiens
  Payload ID: 5975
  Gene Symbol: FAM81B
  Gene Name: family with sequence similarity 81, member B
  ENSP ID: ENSP00000421181
IQEFVPALETLSKNLDMKEKSENKMEEKLLQLSSKVENFINTQKQETQLSKVKHMENKLSKKMEQMEKQIWGELETMQNEYQSGFKSIHDSLSSLQQIQKTKMDLEKYKVQKDLKKLQRKIVELQEV

SEQ ID NO: 30485 - protein, 53 aa, Homo sapiens
  Payload ID: 5975
  Gene Symbol: FAM81B
  Gene Name: family with sequence similarity 81, member B
  ENSP ID: ENSP00000422946
VMQLLGKIETASSEQTSNLKMVQGDYRHEMNLLEFKKSLKIKWKKNCCSFQAK

SEQ ID NO: 30486 - protein, 182 aa, Homo sapiens
  Payload ID: 5975
  Gene Symbol: FAM81B
  Gene Name: family with sequence similarity 81, member B
  ENSP ID: ENSP00000423016
  MOD_RES (1)..(1): Any amino acid
XTATAEEQPVEPDGPLPGSDNNQEKKVRLSPAKMSTKNSTDLVEYVDKSHAFLPIIPNTQRGQLEDRLNNQARTIAFLLEQAFRIKEDISACLQGTHGFRKEESLARKLLESHIQTITSIVKKLSQNIEILEDQIRARDQAATGTNFAVHEINIKHLQGVGDLRGRVARTSLLARLYLRETG

SEQ ID NO: 30487 - protein, 41 aa, Homo sapiens
  Payload ID: 5975
  Gene Symbol: FAM81B
  Gene Name: family with sequence similarity 81, member B
  ENSP ID: ENSP00000423296
  MOD_RES (1)..(1): Any amino acid
XPDGPLPGSDNNQEKKVRLSPAKMSTKNSTDLVEYVDKEVS

SEQ ID NO: 30488 - protein, 87 aa, Homo sapiens
  Payload ID: 5975
  Gene Symbol: FAM81B
  Gene Name: family with sequence similarity 81, member B
  ENSP ID: ENSP00000423648
  MOD_RES (1)..(1): Any amino acid
XASPTATAEEQPVEPDGPLPGSDNNQEKKVRLSPAKMSTKNSTDLVEYVDKGPMAFEKRNRSPGSYWKATSRPSPASSKNSAKILRF

SEQ ID NO: 30489 - protein, 126 aa, Homo sapiens
  Payload ID: 5975
  Gene Symbol: FAM81B
  Gene Name: family with sequence similarity 81, member B
  ENSP ID: ENSP00000424883
AEEQPVEPDGPLPGSDNNQEKKVRLSPAKMSTKNSTDLVEYVDKSHAFLPIIPNTQRGQLEDRLNNQARTIAFLLEQAFRIKEDISACLQGTHGFRKEESLARKLLESHIQTITSIVKKLSQNIEM

SEQ ID NO: 30490 - protein, 367 aa, Homo sapiens
  Payload ID: 5976
  Gene Symbol: FAM83A
  Gene Name: family with sequence similarity 83, member A
  Uniprot ID: Q86UY5
  ENSP ID: ENSP00000276699
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQVLVILMDVFTDVEIFCDILEAANKRGVFVCVLLDQGGVKLFQEMCDKVQISDSHLKNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPVPESKQNKTKTKKQTTLWFLMAF

SEQ ID NO: 30491 - protein, 294 aa, Homo sapiens
  Payload ID: 5976
  Gene Symbol: FAM83A
  Gene Name: family with sequence similarity 83, member A
  Uniprot ID: Q86UY5
  ENSP ID: ENSP00000427979
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPGTRTDG

SEQ ID NO: 30492 - protein, 434 aa, Homo sapiens
  Payload ID: 5976
  Gene Symbol: FAM83A
  Gene Name: family with sequence similarity 83, member A
  Uniprot ID: Q86UY5
  ENSP ID: ENSP00000428876
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQVLVILMDVFTDVEIFCDILEAANKRGVFVCVLLDQGGVKLFQEMCDKVQISDSHLKNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPGTRSVSASSGPCSPAAPHPPPPPRFQPHQGPWGAPSPQAHLSPRPHDGPPAAVYSNLGAYRPTRLQLEQLGLVPRLTPTWRPFLQASPHF

SEQ ID NO: 30493 - protein, 367 aa, Homo sapiens; identical to SEQ ID NO: 30490
  Payload ID: 5976
  Gene Symbol: FAM83A
  Gene Name: family with sequence similarity 83, member A
  Uniprot ID: Q86UY5
  ENSP ID: ENSP00000445218

SEQ ID NO: 30494 - protein, 1011 aa, Homo sapiens
  Payload ID: 5977
  Gene Symbol: FAM83B
  Gene Name: family with sequence similarity 83, member B
  Uniprot ID: Q5T0W9
  ENSP ID: ENSP00000304078
METSSMLSSLNDECKSDNYIEPHYKEWYRVAIDILIEHGLEAYQEFLVQERVSDFLAEEEINYILKNVQKVAQSTAHGTDDSCDDTLSSGTYWPVESDVEAPNLDLGWPYVMPGLLGGTHIDLLFHPPRAHLLTIKETIRKMIKEARKVIALVMDIFTDVDIFKEIVEASTRGVSVYILLDESNFNHFLNMTEKQGCSVQRLRNIRVRTVKGQDYLSKTGAKFHGKMEQKFLLVDCQKVMYGSYSYMWSFEKAHLSMVQIITGQLVESFDEEFRTLYARSCVPSSFAQEESARVKHGKALWENGTYQHSVSSLASVSSQRNLFGRQDKIHKLDSSYFKNRGIYTLNEHDKYNIRSHGYKPHFVPNFNGPNAIRQFQPNQINENWKRHSYAGEQPETVPYLLLNRALNRTNNPPGNWKKPSDSLSVASSSREGYVSHHNTPAQSFANRLAQRKTTNLADRNSNVRRSFNGTDNHIRFLQQRMPTLEHTTKSFLRNWRIESYLNDHSEATPDSNGSALGDRFEGYDNPENLKANALYTHSRLRSSLVFKPTLPEQKEVNSCTTGSSNSTIIGSQGSETPKEVPDTPTNVQHLTDKPLPESIPKLPLQSEAPKMHTLQVPENHSVALNQTTNGHTESNNYIYKTLGVNKQTENLKNQQTENLLKRRSFPLFDNSKANLDPGNSKHYVYSTLTRNRVRQPEKPKEDLLKSSKSMHNVTHNLEEDEEEVTKRNSPSGTTTKSVSIAALLDVNKEESNKELASKKEVKGSPSFLKKGSQKLRSLLSLTPDKKENLSKNKAPAFYRLCSSSDTLVSEGEENQKPKKSDTKVDSSPRRKHSSSSNSQGSIHKSKEDVTVSPSQEINAPPDENKRTPSPGPVESKFLERAGDASAPRFNTEQIQYRDSREINAVVTPERRPTSSPRPTSSELLRSHSTDRRVYSRFEPFCKIESSIQPTSNMPNTSINRPEIKSATMGNSYGRSSPLLNYNTGVYRSYQPNENKFRGFMQKFGNFIHKNK

SEQ ID NO: 30495 - protein, 747 aa, Homo sapiens
  Payload ID: 5978
  Gene Symbol: FAM83C
  Gene Name: family with sequence similarity 83, member C
  Uniprot ID: Q9BQN1
  ENSP ID: ENSP00000363529
MFGGPGPGVLGAQGMAGPLRGRVEELKLPWWRESSPLVLRHSEAARLAADALLERGEAAYLRVISEERELPFLSALDVDYMTSHVRGGPELSEAQGQEASGPDRLSLLSEVTSGTYFPMASDIDPPDLDLGWPEVPQATGFSPTQAVVHFQRDKAKNIKDLLRFLFSQAHTVVAVVMDIFTDMELLCDLMEASSRRGVPVYLLLAQEHLRHFLEMCYKMDLNGEHLPNMRVRSTCGDTYCSKAGRRFTGQALEKFVLIDCEQVVAGSYSFTWLCSQAHTSMVLQLRGRIVEDFDREFRCLYAESQPVEGFCGGEDPLSPRALRPPPVALAFRPDVPSPTSSLPSSTSLSSIKQSPLMGRSSYLALPGGGDCSDTGVVSSSLGPARREASGQPSLHRQLSDPNHGSPPGLYRANLGKLGAYPWSQSSPALNHNSTSPLTLAVGSPLLPRSRPLLQFHRGAPALSRFPENGLPGSQEPSPLRGRWVPGTTLETVEEKEKKASPSQSRGQLDLLVPFPRAREVGDPDSGVTPNSGPLRPGEQAPEDRRLSPSQADSQLDLLSRALGTGGAPELGSLRPGDRALEDRRLSLNQSRGQSDLLMQYPKAQGSRVPLETNSSARPARRAPDERRQTLGHSQLDLITKFGPFRGEGPGPNGLPISSPARTAGAGSGDEKRLTLGHSKLDLITKYHQLHGARQGTEPGGPKGGHLNGGNSDLVRDEKRLTLGHSKLDLITKYNKSKFKQLRSRFES

SEQ ID NO: 30496 - protein, 615 aa, Homo sapiens
  Payload ID: 5979
  Gene Symbol: FAM83D
  Gene Name: family with sequence similarity 83, member D
  ENSP ID: ENSP00000217429
MARACLIQRLPIKRDCTPVFVRGLSSPSAAMALLSEGLDEVPAACLSPCGPPNPTELFSESRRLALEELVAGGPEAFAAFLRRERLARFLNPDEVHAILRAAERPGEEGAAAAAAAEDSFGSSHDCSSGTYFPEQSDLEPPLLELGWPAFYQGAYRGATRVETHFQPRGAGEGGPYGCKDALRQQLRSAREVIAVVMDVFTDIDIFRDLQEICRKQGVAVYILLDQALLSQFLDMCMDLKVHPEQEKLMTVRTITGNIYYARSGTKIIGKVHEKFTLIDGIRVATGSYSFTWTDGKLNSSNLVILSGQVVEHFDLEFRILYAQSKPISPKLLSHFQSSNKFDHLTNRKPQSKELTLGNLLRMRLARLSSTPRKADLDPEMPAEGKAERKPHDCESSTVSEEDYFSSHRDELQSRKAIDAATQTEPGEEMPGLSVSEVGTQTSITTACAGTQTAVITRIASSQTTIWSRSTTTQTDMDENILFPRGTQSTEGSPVSKMSVSRSSSLKSSSSVSSQGSVASSTGSPASIRTTDFHNPGYPKYLGTPHLELYLSDSLRNLNKERQFHFAGIRSRLNHMLAMLSRRTLFTENHLGLHSGNFSRVNLLAVRDVALYPSYQ

SEQ ID NO: 30497 - protein, 615 aa, Homo sapiens; identical to SEQ ID NO: 30496
  Payload ID: 5979
  Gene Symbol: FAM83D
  Gene Name: family with sequence similarity 83, member D
  ENSP ID: ENSP00000481110

SEQ ID NO: 30498 - protein, 585 aa, Homo sapiens
  Payload ID: 5979
  Gene Symbol: FAM83D
  Gene Name: family with sequence similarity 83, member D
  Uniprot ID: Q9H4H8
  ENSP ID: ENSP00000481465
MALLSEGLDEVPAACLSPCGPPNPTELFSESRRLALEELVAGGPEAFAAFLRRERLARFLNPDEVHAILRAAERPGEEGAAAAAAAEDSFGSSHDCSSGTYFPEQSDLEPPLLELGWPAFYQGAYRGATRVETHFQPRGAGEGGPYGCKDALRQQLRSAREVIAVVMDVFTDIDIFRDLQEICRKQGVAVYILLDQALLSQFLDMCMDLKVHPEQEKLMTVRTITGNIYYARSGTKIIGKVHEKFTLIDGIRVATGSYSFTWTDGKLNSSNLVILSGQVVEHFDLEFRILYAQSKPISPKLLSHFQSSNKFDHLTNRKPQSKELTLGNLLRMRLARLSSTPRKADLDPEMPAEGKAERKPHDCESSTVSEEDYFSSHRDELQSRKAIDAATQTEPGEEMPGLSVSEVGTQTSITTACAGTQTAVITRIASSQTTIWSRSTTTQTDMDENILFPRGTQSTEGSPVSKMSVSRSSSLKSSSSVSSQGSVASSTGSPASIRTTDFHNPGYPKYLGTPHLELYLSDSLRNLNKERQFHFAGIRSRLNHMLAMLSRRTLFTENHLGLHSGNFSRVNLLAVRDVALYPSYQ

SEQ ID NO: 30499 - protein, 478 aa, Homo sapiens
  Payload ID: 5980
  Gene Symbol: FAM83E
  Gene Name: family with sequence similarity 83, member E
  Uniprot ID: Q2M2I3
  ENSP ID: ENSP00000263266
MAASQLAALEGVDSGPRVPGASPGFLYSEGQRLALEALLSKGAEAFQTCVQREELWPFLSADEVQGLAAAAEDWTVAKQEPSGMAEGATTTDVDAGSLSYWPGQSEQPAPVLRLGWPVDSAWKGITRAQLYTQPPGEGQPPLKELVRLEIQAAHKLVAVVMDVFTDPDLLLDLVDAATRRWVPVYLLLDRQQLPAFLELAQQLGVNPWNTENVDVRVVRGCSFQSRWRRQVSGTVREKFVLLDGERVISGSYSFTWSDARLHRGLVTLLTGEIVDAFSLEFRTLYAASCPLPPAPPQKPSVIGGLQRGRSPHRVSRRRSVAPASPPPPDGPLAHRLAACRVSPATPGPALSDILRSVQRARTPSGPPARPSRSMWDLSRLSQLSGSSDGDNELKKSWGSKDTPAKALMRQRGTGGGPWGEVDSRPPWGGALPLPPAHRLRYLSPARRRFGGDATFKLQEPRGVRPSDWAPRAGLGGQP

SEQ ID NO: 30500 - protein, 91 aa, Homo sapiens
  Payload ID: 5980
  Gene Symbol: FAM83E
  Gene Name: family with sequence similarity 83, member E
  ENSP ID: ENSP00000470271
MAEGATTTDVDAGSLSYWPGQSEQPAPVLRLGWPVDSAWKGITRAQLYTQPPGEGQPPLKELVRLEIQAAHKLVAVVMDVFTDPDLLLDLV

SEQ ID NO: 30501 - protein, 500 aa, Homo sapiens
  Payload ID: 5981
  Gene Symbol: FAM83F
  Gene Name: family with sequence similarity 83, member F
  Uniprot ID: Q8NEG4
  ENSP ID: ENSP00000330432
MAESQLNCLDEAHVNEKVTEAQAAFYYCERRRAALEALLGGGEQAYRERLKEEQLRDFLSSPERQALRAAWSPYEDAVPAANARGKSKAKAKAPAPAPAESGESLAYWPDRSDTEVPPLDLGWTDTGFYRGVSRVTLFTHPPKDEKAPHLKQVVRQMIQQAQKVIAVVMDLFTDGDIFQDIVDAACKRRVPVYIILDEAGVKYFLEMCQDLQLTDFRIRNIRVRSVTGVGFYMPMGRIKGTLSSRFLMVDGDKVATGSYRFTWSSSHVDRNLLLLLTGQNVEPFDTEFRELYAISEEVDLYRQLSLAGRVGLHYSSTVARKLINPKYALVSGCRHPPGEMMRWAARQQREAGGNPEGQEEGASGGESAWRLESFLKDLVTVEQVLPPVEPIPLGELSQKDGRMVSHMHRDLKPKSREAPSRNGMGEAARGEAAPARRFSSRLFSRRAKRPAAPNGMASSVSTETSEVEFLTGKRPNENSSADISGKTSPSSAKPSNCVIS

SEQ ID NO: 30502 - protein, 332 aa, Homo sapiens
  Payload ID: 5981
  Gene Symbol: FAM83F
  Gene Name: family with sequence similarity 83, member F
  Uniprot ID: Q8NEG4
  ENSP ID: ENSP00000476600
MDLFTDGDIFQDIVDAACKRRVPVYIILDEAGVKYFLEMCQDLQLTDFRIRNIRVRSVTGVGFYMPMGRIKGTLSSRFLMVDGDKVATGSYRFTWSSSHVDRNLLLLLTGQNVEPFDTEFRELYAISEEVDLYRQLSLAGRVGLHYSSTVARKLINPKYALVSGCRHPPGEMMRWAARQQREAGGNPEGQEEGASGGESAWRLESFLKDLVTVEQVLPPVEPIPLGELSQKDGRMVSHMHRDLKPKSREAPSRNGMGEAARGEAAPARRFSSRLFSRRAKRPAAPNGMASSVSTETSEVEFLTGKRPNENSSADISGKTSPSSAKPSNCVIS

SEQ ID NO: 30503 - protein, 823 aa, Homo sapiens
  Payload ID: 5982
  Gene Symbol: FAM83G
  Gene Name: family with sequence similarity 83, member G
  Uniprot ID: A6ND36
  ENSP ID: ENSP00000343279
MAFSQVQCLDDNHVNWRSSESKPEFFYSEEQRLALEALVARGRDAFYEVLKRENIRDFLSELELKRILETIEVYDPGSEDPRGTGPSQGPEDNGVGDGEEASGADGVPIEAEPLPSLEYWPQKSDRSIPQLDLGWPDTIAYRGVTRASVYMQPPIDGQAHIKEVVRKMISQAQKVIAVVMDMFTDVDIFKDLLDAGFKRKVAVYIIVDESNVKYFLHMCERACMHLGHLKNLRVRSSGGTEFFTRSATKFKGALAQKFMFVDGDRAVCGSYSFTWSAARTDRNVISVLSGQVVEMFDRQFQELYLMSHSVSLKGIPMEKEPEPEPIVLPSVVPLVPAGTVAKKLVNPKYALVKAKSVDEIAKISSEKQEAKKPLGLKGPALAEHPGELPELLPPIHPGLLHLERANMFEYLPTWVEPDPEPGSDILGYINIIDPNIWNPQPSQMNRIKIRDTSQASAQHQLWKQSQDSRPRPEPCPPPEPSAPQDGVPAENGLPQGDPEPLPPVPKPRTVPVADVLARDSSDIGWVLELPKEEAPQNGTDHRLPRMAGPGHAPLQRQLSVTQDDPESLGVGLPNGLDGVEEEDDDDYVTLSDQDSHSGSSGRGPGPRRPSVASSVSEEYFEVREHSVPLRRRHSEQVANGPTPPPRRQLSAPHITRGTFVGPQGGSPWAQSRGREEADALKRMQAQRSTDKEAQGQQFHHHRVPASGTRDKDGFPGPPRYRSAADSVQSSTRNAGPAMAGPHHWQAKGGQVPRLLPDPGSPRLAQNARPMTDGRATEEHPSPFGIPYSKLSQSKHLKARTGGSQWASSDSKRRAQAPRDRKDP

SEQ ID NO: 30504 - protein, 823 aa, Homo sapiens; identical to SEQ ID NO: 30503
  Payload ID: 5982
  Gene Symbol: FAM83G
  Gene Name: family with sequence similarity 83, member G
  Uniprot ID: A6ND36
  ENSP ID: ENSP00000373647

SEQ ID NO: 30505 - protein, 142 aa, Homo sapiens
  Payload ID: 5982
  Gene Symbol: FAM83G
  Gene Name: family with sequence similarity 83, member G
  ENSP ID: ENSP00000465602
  MOD_RES (1)..(1): Any amino acid
XDSHSGSSGRGPGPRRPSVASSVSEEYFEVREHSVPLRRRHSEQVANGPTPPPRRQLSAPHITRGTFVGPQGGSPWAQSRGREEADALKRMQAQRSTDKEAQDKVPEPWVPCSLGSVPGARPTWEQCAADHARHDDQAHGEH

SEQ ID NO: 30506 - protein, 1179 aa, Homo sapiens
  Payload ID: 5983
  Gene Symbol: FAM83H
  Gene Name: family with sequence similarity 83, member H
  Uniprot ID: Q6ZRV2
  ENSP ID: ENSP00000373565
MARRSQSSSQGDNPLAPGYLPPHYKEYYRLAVDALAEGGSEAYSRFLATEGAPDFLCPEELEHVSRHLRPPQYVTREPPEGSLLDVDMDGSSGTYWPVNSDQAVPELDLGWPLTFGFQGTEVTTLVQPPPPDSPSIKDEARRMIRSAQQVVAVVMDMFTDVDLLSEVLEAAARRVPVYILLDEMNAQHFLDMADKCRVNLQHVDFLRVRTVAGPTYYCRTGKSFKGHVKEKFLLVDCAVVMSGSYSFMWSFEKIHRSLAHVFQGELVSSFDEEFRILFAQSEPLVPSAAALARMDAYALAPYAGAGPLVGVPGVGAPTPFSFPKRAHLLFPPPREEGLGFPSFLDPDRHFLSAFRREEPPRMPGGALEPHAGLRPLSRRLEAEAGPAGELAGARGFFQARHLEMDAFKRHSFATEGAGAVENFAAARQVSRQTFLSHGDDFRFQTSHFHRDQLYQQQYQWDPQLTPARPQGLFEKLRGGRAGFADPDDFTLGAGPRFPELGPDGHQRLDYVPSSASREVRHGSDPAFAPGPRGLEPSGAPRPNLTQRFPCQAAARPGPDPAPEAEPERRGGPEGRAGLRRWRLASYLSGCHGEDGGDDGLPAPMEAEAYEDDVLAPGGRAPAGDLLPSAFRVPAAFPTKVPVPGPGSGGNGPEREGPEEPGLAKQDSFRSRLNPLVQRSSRLRSSLIFSTSQAEGAAGAAAATEKVQLLHKEQTVSETLGPGGEAVRSAASTKVAELLEKYKGPARDPGGGAGAITVASHSKAVVSQAWREEVAAPGAVGGERRSLESCLLDLRDSFAQQLHQEAERQPGAASLTAAQLLDTLGRSGSDRLPSRFLSAQSHSTSPQGLDSPLPLEGSGAHQVLHNESKGSPTSAYPERKGSPTPGFSTRRGSPTTGFIEQKGSPTSAYPERRGSPVPPVPERRSSPVPPVPERRGSLTLTISGESPKAGPAEEGPSGPMEVLRKGSLRLRQLLSPKGERRMEDEGGFPVPQENGQPESPRRLSLGQGDSTEAATEERGPRARLSSATANALYSSNLRDDTKAILEQISAHGQKHRAVPAPSPGPTHNSPELGRPPAAGVLAPDMSDKDKCSAIFRSDSLGTQGRLSRTLPASAEERDRLLRRMESMRKEKRVYSRFEVFCKKEEASSPGAGEGPAEEGTRDSKVGKFVPKILGTFKSKK

SEQ ID NO: 30507 - protein, 906 aa, Homo sapiens
  Payload ID: 5983
  Gene Symbol: FAM83H
  Gene Name: family with sequence similarity 83, member H
  ENSP ID: ENSP00000378535
  MOD_RES (1)..(1): Any amino acid
XRILFAQSEPLVPSAAALARMDAYALAPYAGAGPLVGVPGVGAPTPFSFPKRAHLLFPPPREEGLGFPSFLDPDRHFLSAFRREEPPRMPGGALEPHAGLRPLSRRLEAEAGPAGELAGARGFFQARHLEMDAFKRHSFATEGAGAVENFAAARQVSRQTFLSHGDDFRFQTSHFHRDQLYQQQYQWDPQLTPARPQGLFEKLRGGRAGFADPDDFTLGAGPRFPELGPDGHQRLDYVPSSASREVRHGSDPAFAPGPRGLEPSGAPRPNLTQRFPCQAAARPGPDPAPEAEPERRGGPEGRAGLRRWRLASYLSGCHGEDGGDDGLPAPMEAEAYEDDVLAPGGRAPAGDLLPSAFRVPAAFPTKVPVPGPGSGGNGPEREGPEEPGLAKQDSFRSRLNPLVQRSSRLRSSLIFSTSQAEGAAGAAAATEKVQLLHKEQTVSETLGPGGEAVRSAASTKVAELLEKYKGPARDPGGGAGAITVASHSKAVVSQAWREEVAAPGAVGGERRSLESCLLDLRDSFAQQLHQEAERQPGAASLTAAQLLDTLGRSGSDRLPSRFLSAQSHSTSPQGLDSPLPLEGSGAHQVLHNESKGSPTSAYPERKGSPTPGFSTRRGSPTTGFIEQKGSPTSAYPERRGSPVPPVPERRSSPVPPVPERRGSLTLTISGESPKAGPAEEGPSGPMEVLRKGSLRLRQLLSPKGERRMEDEGGFPVPQENGQPESPRRLSLGQGDSTEAATEERGPRARLSSATANALYSSNLRDDTKAILEQISAHGQKHRAVPAPSPGPTHNSPELGRPPAAGVLAPDMSDKDKCSAIFRSDSLGTQGRLSRTLPASAEERDRLLRRMESMRKEKRVYSRFEVFCKKEEASSPGAGEGPAEEGTRDSKVGKFVPKILGTFKSKK

SEQ ID NO: 30508 - protein, 1179 aa, Homo sapiens; identical to SEQ ID NO: 30506
  Payload ID: 5983
  Gene Symbol: FAM83H
  Gene Name: family with sequence similarity 83, member H
  Uniprot ID: Q6ZRV2
  ENSP ID: ENSP00000478790

SEQ ID NO: 30509 - protein, 906 aa, Homo sapiens; identical to SEQ ID NO: 30507
  Payload ID: 5983
  Gene Symbol: FAM83H
  Gene Name: family with sequence similarity 83, member H
  ENSP ID: ENSP00000488269
  MOD_RES (1)..(1): Any amino acid

SEQ ID NO: 30510 - protein, 292 aa, Homo sapiens
  Payload ID: 5984
  Gene Symbol: FAM84A
  Gene Name: family with sequence similarity 84, member A
  Uniprot ID: Q96KN4
  ENSP ID: ENSP00000295092
MGNQLDRITHLNYSELPTGDPSGIEKDELRVGVAYFFSDDEEDLDERGQPDKFGVKAPPGCTPCPESPSRHHHHLLHQLVLNETQFSAFRGQECIFSKVSGGPQGADLSVYAVTALPALCEPGDLLELLWLQPAPEPPAPAPHWAVYVGGGQIIHLHQGEIRQDSLYEAGAANVGRVVNSWYRYRPLVAELVVQNACGHLGLKSEEICWTNSESFAAWCRFGKREFKAGGEVPAGTQPPQQQYYLKVHLGENKVHTARFHSLEDLIREKRRIDASGRLRVLQELADLVDDKE

SEQ ID NO: 30511 - protein, 292 aa, Homo sapiens; identical to SEQ ID NO: 30510
  Payload ID: 5984
  Gene Symbol: FAM84A
  Gene Name: family with sequence similarity 84, member A
  Uniprot ID: Q96KN4
  ENSP ID: ENSP00000330681

SEQ ID NO: 30512 - protein, 310 aa, Homo sapiens
  Payload ID: 5985
  Gene Symbol: FAM84B
  Gene Name: family with sequence similarity 84, member B
  Uniprot ID: Q96KN1
  ENSP ID: ENSP00000302578
MGNQVEKLTHLSYKEVPTADPTGVDRDDGPRIGVSYIFSNDDEDVEPQPPPQGPDGGGLPDGGDGPPPPQPQPYDPRLHEVECSVFYRDECIYQKSFAPGSAALSTYTPENLLNKCKPGDLVEFVSQAQYPHWAVYVGNFQVVHLHRLEVINSFLTDASQGRRGRVVNDLYRYKPLSSSAVVRNALAHVGAKERELSWRNSESFAAWCRYGKREFKIGGELRIGKQPYRLQIQLSAQRSHTLEFQSLEDLIMEKRRNDQIGRAAVLQELATHLHPAEPEEGDSNVARTTPPPGRPPAPSSEEEDGEAVAH

SEQ ID NO: 30513 - protein, 153 aa, Homo sapiens
  Payload ID: 5986
  Gene Symbol: FAM86B1
  Gene Name: family with sequence similarity 86, member B1
  Uniprot ID: Q8N7N1
  ENSP ID: ENSP00000342610
MAPEENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRRAVLPRSHRVAGRGPAEAGCLPGAQAGS

SEQ ID NO: 30514 - protein, 296 aa, Homo sapiens
  Payload ID: 5986
  Gene Symbol: FAM86B1
  Gene Name: family with sequence similarity 86, member B1
  Uniprot ID: Q8N7N1
  ENSP ID: ENSP00000407067
MAPEENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRTVLELGSGAGLTGLAICKMCRPRAYIFSDPHSRVLEQLRGNVLLNGLSLEADITGNLDSPRVTVAQLDWDVAMVHQLSAFQPDVVIAADVLYCPEAIVSLVGVLQRLAACREHKRAPEVYVAFTVRNPETCQLFTTELGRDGIRWEAEAHHDQKLFPYGEHLEMAMLNLTL

SEQ ID NO: 30515 - protein, 153 aa, Homo sapiens; identical to SEQ ID NO: 30513
  Payload ID: 5986
  Gene Symbol: FAM86B1
  Gene Name: family with sequence similarity 86, member B1
  Uniprot ID: Q8N7N1
  ENSP ID: ENSP00000431362

SEQ ID NO: 30516 - protein, 58 aa, Homo sapiens
  Payload ID: 5986
  Gene Symbol: FAM86B1
  Gene Name: family with sequence similarity 86, member B1
  ENSP ID: ENSP00000432250
MAPEENAGTELLLQGFERRFLAVRTLRSFPWQAVIVLVTGTQLHSPILKSQRPQARGA

SEQ ID NO: 30517 - protein, 97 aa, Homo sapiens
  Payload ID: 5986
  Gene Symbol: FAM86B1
  Gene Name: family with sequence similarity 86, member B1
  ENSP ID: ENSP00000432790
APEENAGTELLLQGFERRFLAVRTLRSFPWQSLEAKLRDSSDSELLRDILQKSSGGSVTLSKSTAIISHGTTGLVTWDAALYLAEWAIENPAAFINR

SEQ ID NO: 30518 - protein, 330 aa, Homo sapiens
  Payload ID: 5986
  Gene Symbol: FAM86B1
  Gene Name: family with sequence similarity 86, member B1
  ENSP ID: ENSP00000432931
MAPEENAGTELLLQGFERRFLAVRTLRSFPWQSLEAKLRDSSDSELLRDILQKTVRHPVCVKHPPSVKYAWCFLSELIKKHEAVHTEPLDKLYEVLTETLMAKESTQGHRSYLLSSGGSVTLSKSTAIISHGTTGLVTWDAALYLAEWAIENPAAFINRTVLELGSGAGLTGLAICKMCRPRAYIFSDPHSRVLEQLRGNVLLNGLSLEADITGNLDSPRVTVAQLDWDVAMVHQLSAFQPDVVIAADVLYCPEAIVSLVGVLQRLAACREHKRAPEVYVAFTVRNPETCQLFTTELGRDGIRWEAEAHHDQKLFPYGEHLEMAMLNLTL

SEQ ID NO: 30519 - protein, 105 aa, Homo sapiens
  Payload ID: 5986
  Gene Symbol: FAM86B1
  Gene Name: family with sequence similarity 86, member B1
  ENSP ID: ENSP00000433147
MAPEENAGTELLLQGFERRFLAVRTLRSFPWQSSGGSVTLSKSTAIISHGTTGLVTWDAALYLAEWAIENPAAFINRRAVLPRSHRVAGRGPAEAGCLPGAQAGS

SEQ ID NO: 30520 - protein, 102 aa, Homo sapiens
  Payload ID: 5986
  Gene Symbol: FAM86B1
  Gene Name: family with sequence similarity 86, member B1
  ENSP ID: ENSP00000433972
  MOD_RES (1)..(1): Any amino acid
XPEENAGTELLLQGFERRFLAVRTLRSFPWQSLEAKLRDSSDSELLRDILQKTVRHPVCVKHPPSVKYAWCFLSELIKKRQDLCCPGCPRTPGLKQSSHVSL

SEQ ID NO: 30521 - protein, 102 aa, Homo sapiens
  Payload ID: 5986
  Gene Symbol: FAM86B1
  Gene Name: family with sequence similarity 86, member B1
  ENSP ID: ENSP00000434799
MAPEENAGTELLLQGFERRFLAVRTLRSFPWQSLEAKLRDSSDSELLRDILQKTCCIAQKPSCRWSGSCRGWLPAGSTSGLLRSTWPLPSATQRRASCSPPS

SEQ ID NO: 30522 - protein, 159 aa, Homo sapiens
  Payload ID: 5986
  Gene Symbol: FAM86B1
  Gene Name: family with sequence similarity 86, member B1
  ENSP ID: ENSP00000435201
MAPEENAGTELLLQGFERRFLAVRTLRSFPWQSLEAKLRDSSDSELLRDILQKTVRHPVCVKHPPSVKYAWCFLSELIKKHEAVHTEPLDKLYEVLTETLMAKESTQGHRSYLLSSGGSVTLSKSTAIISHGTTGLVTWDAALYLAEWAIENPAAFINR

SEQ ID NO: 30523 - protein, 66 aa, Homo sapiens
  Payload ID: 5986
  Gene Symbol: FAM86B1
  Gene Name: family with sequence similarity 86, member B1
  ENSP ID: ENSP00000436024
MAPEENAGTELLLQGFERRFLAVRTLRSFPWQVGGGASGEARGGRGSPGADGMGLRAETPGAPATA

SEQ ID NO: 30524 - protein, 59 aa, Homo sapiens
  Payload ID: 5986
  Gene Symbol: FAM86B1
  Gene Name: family with sequence similarity 86, member B1
  ENSP ID: ENSP00000444227
MPGAFSQNSSKSPQEAQSHSPRAQPSSPTVPQAWSHGMPPSTLQNGPSRTRQPSLTGLS

SEQ ID NO: 30525 - protein, 66 aa, Homo sapiens; identical to SEQ ID NO: 30523
  Payload ID: 5986
  Gene Symbol: FAM86B1
  Gene Name: family with sequence similarity 86, member B1
  ENSP ID: ENSP00000473414

SEQ ID NO: 30526 - protein, 108 aa, Homo sapiens
  Payload ID: 5986
  Gene Symbol: FAM86B1
  Gene Name: family with sequence similarity 86, member B1
  ENSP ID: ENSP00000473457
MAPEENAGTELLLQGFERRFLAVRTLRSFPWQVGGGASGEARGGRGSPGADGMGLRAETPGAPATCTLRHLKVRLSAAVASTSNWLHVPREGSHRALPTHSIACLMFL

SEQ ID NO: 30527 - protein, 69 aa, Homo sapiens
  Payload ID: 5986
  Gene Symbol: FAM86B1
  Gene Name: family with sequence similarity 86, member B1
  ENSP ID: ENSP00000473629
MPGAFSQNSSKRDKISVAQAVLELLGSSSPPTSAFRVAGTIRHTPPRPTNTRLSTRSLWTNCTRCSRRL

SEQ ID NO: 30528 - protein, 330 aa, Homo sapiens
  Payload ID: 5987
  Gene Symbol: FAM86B2
  Gene Name: family with sequence similarity 86, member B2
  Uniprot ID: P0C5J1
  ENSP ID: ENSP00000262365
MAPEENAGTELLLQGFERRFLAVRTLRSFPWQSLEAKLRDSSDSELLRDILQKTVRHPVCVKHPPSVKYAWCFLSELIKKHEAVHTEPLDKLYEVLAETLMAKESTQGHRSYLLSSGGSVTLSKSTAIISHGTTGLVTWDAALYLAEWAIENPAAFINRTVLELGSGAGLTGLAICKMCRPRAYIFSDPHSRILEQLRGNVLLNGLSLEADITGNLDSPRVTVAQLDWDVAMVHQLSAFQPDVVIAADVLYCPEAIVSLVGVLQRLAACREHKRAPEVYVAFTVRNPETCQLFTTELGRDGIRWEAEAHHDQKLFPYGEHLEMAMLNLTL

SEQ ID NO: 30529 - protein, 139 aa, Homo sapiens
  Payload ID: 5987
  Gene Symbol: FAM86B2
  Gene Name: family with sequence similarity 86, member B2
  ENSP ID: ENSP00000311330
MPGAFSQNSSKSPQEAQSHSPRAQPSSPTVPQAWSHGMPPSTLQNGPSRTRQPSLTDVLYCPEAIVSLVGVLQRLAACREHKRAPEVYVAFTVRNPETCQLFTTELGRDGIRWEAEAHHDQKLFPYGEHLEMAMLNLTL

SEQ ID NO: 30530 - protein, 295 aa, Homo sapiens
  Payload ID: 5987
  Gene Symbol: FAM86B2
  Gene Name: family with sequence similarity 86, member B2
  ENSP ID: ENSP00000432491
MAPEENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRTVLELGSGAGLTGLAICKMCRPRAYIFSDPHSRILEQLRGNVLLNGLSLEADITGNLDSPRVTVAQLDWDVAMVHQLSAFQPDVVIAADVLYCPEAIVSLVGVLQRLAACREHKRAPEVYVAFTVRNPETCQLFTTELGRDGIRWEAEAHHDQKLFPYGEHLEMAMLNLT

SEQ ID NO: 30531 - protein, 149 aa, Homo sapiens
  Payload ID: 5987
  Gene Symbol: FAM86B2
  Gene Name: family with sequence similarity 86, member B2
  ENSP ID: ENSP00000436338
MAPEENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRRAVLPRSHRVAGRGPAEAGCLPGA

SEQ ID NO: 30532 - protein, 131 aa, Homo sapiens
  Payload ID: 5988
  Gene Symbol: FAM86C1
  Gene Name: family with sequence similarity 86, member C1
  Uniprot ID: Q9NVL1
  ENSP ID: ENSP00000325662
MAPEENAGSELLLQSFKRRFLAARALRSFRWQSLEAKLRDSSDSELLRDILQKTCCIAQKPSCRWSGSCGGWLPAGSTSGLLNSTWPLPSATQRCASCSPPSYAGLGSDGKRKLIMTRNCFPTESTWRWQS

SEQ ID NO: 30533 - protein, 165 aa, Homo sapiens
  Payload ID: 5988
  Gene Symbol: FAM86C1
  Gene Name: family with sequence similarity 86, member C1
  Uniprot ID: Q9NVL1
  ENSP ID: ENSP00000352182
MAPEENAGSELLLQSFKRRFLAARALRSFRWQSLEAKLRDSSDSELLRDILQKHEAVHTEPLDELYEVLVETLMAKESTQGHRSYLLTCCIAQKPSCRWSGSCGGWLPAGSTSGLLNSTWPLPSATQRCASCSPPSYAGLGSDGKRKLIMTRNCFPTESTWRWQS

SEQ ID NO: 30534 - protein, 158 aa, Homo sapiens
  Payload ID: 5988
  Gene Symbol: FAM86C1
  Gene Name: family with sequence similarity 86, member C1
  Uniprot ID: Q9NVL1
  ENSP ID: ENSP00000391329
MAPEENAGSELLLQSFKRRFLAARALRSFRWQSLEAKLRDSSDSELLRDILQKTVKHPVCVKHPPSVKYARCFLSELIKKTCCIAQKPSCRWSGSCGGWLPAGSTSGLLNSTWPLPSATQRCASCSPPSYAGLGSDGKRKLIMTRNCFPTESTWRWQS

SEQ ID NO: 30535 - protein, 53 aa, Homo sapiens
  Payload ID: 5988
  Gene Symbol: FAM86C1
  Gene Name: family with sequence similarity 86, member C1
  ENSP ID: ENSP00000423511
MAPEENAGSELLLQSFKRRFLAARALRSFRWQSLEAKLRDSSDSELLRDILQK

SEQ ID NO: 30536 - protein, 53 aa, Homo sapiens; identical to SEQ ID NO: 30535
  Payload ID: 5988
  Gene Symbol: FAM86C1
  Gene Name: family with sequence similarity 86, member C1
  ENSP ID: ENSP00000432416

SEQ ID NO: 30537 - protein, 125 aa, Homo sapiens
  Payload ID: 5988
  Gene Symbol: FAM86C1
  Gene Name: family with sequence similarity 86, member C1
  ENSP ID: ENSP00000436598
MAPEENAGSELLLQSFKRRFLAARALRSFRWQSLEAKLRDSSDSELLRDILQKTCCIAQKPSCRWSGSCGGWLPAGSTSGLLNSTWPLPSATQRCASCSPPSYVSPHAHPGLHGPQAVPTGLQWK

SEQ ID NO: 30538 - protein, 184 aa, Homo sapiens
  Payload ID: 5989
  Gene Symbol: FAM89A
  Gene Name: family with sequence similarity 89, member A
  Uniprot ID: Q96GI7
  ENSP ID: ENSP00000355614
MSGARAAPGAAGNGAVRGLRVDGLPPLPKSLSGLLHSASGGGASGGWRHLERLYAQKSRIQDELSRGGPGGGGARAAALPAKPPNLDAALALLRKEMVGLRQLDMSLLCQLYSLYESIQEYKGACQAASSPDCTYALENGFFDEEEEYFQEQNSLHDRRDRGPPRDLSLPVSSLSSSDWILESI

SEQ ID NO: 30539 - protein, 176 aa, Homo sapiens
  Payload ID: 5990
  Gene Symbol: FAM89B
  Gene Name: family with sequence similarity 89, member B
  Uniprot ID: Q8N5H3
  ENSP ID: ENSP00000314829
MNGLPSAEAPGGAGCALAGLPPLPRGLSGLLNASGGSWRELERVYSQRSRIHDELSRAARAPDGPRHAAGAANAGPAAGPRRPVNLDSALAALRKEMLWGLYESIQDYKHLCQDLSFCQDLSSSLHSDSSYPPDAGLSDDEEPPDASLPPDPPPLTVPQTHNARDQWLQDAFHISL

SEQ ID NO: 30540 - protein, 154 aa, Homo sapiens
  Payload ID: 5990
  Gene Symbol: FAM89B
  Gene Name: family with sequence similarity 89, member B
  Uniprot ID: Q8N5H3
  ENSP ID: ENSP00000402439
MNGLPSAEAPGGAGCALAGLPPLPRGLSGLLNASGGSWRELERVYSQRSRIHDELSRAARAPDGPRHAAGAANAGPAAGPRRPVNLDSALAALRKEMLSAGGAAAVGHVLVVPAVGPVRVNPGLQTPVPRPELLPGPVILPPFGQLLPTGCGPV

SEQ ID NO: 30541 - protein, 189 aa, Homo sapiens
  Payload ID: 5990
  Gene Symbol: FAM89B
  Gene Name: family with sequence similarity 89, member B
  Uniprot ID: Q8N5H3
  ENSP ID: ENSP00000431459
MNGLPSAEAPGGAGCALAGLPPLPRGLSGLLNASGGSWRELERVYSQRSRIHDELSRAARAPDGPRHAAGAANAGPAAGPRRPVNLDSALAALRKEMVGLRQLDMSLLCQLWGLYESIQDYKHLCQDLSFCQDLSSSLHSDSSYPPDAGLSDDEEPPDASLPPDPPPLTVPQTHNARDQWLQDAFHISL

SEQ ID NO: 30542 - protein, 332 aa, Homo sapiens
  Payload ID: 5991
  Gene Symbol: FAM9A
  Gene Name: family with sequence similarity 9, member A
  Uniprot ID: Q8IZU1
  ENSP ID: ENSP00000370391
MEPVGRKRSRKAAKAQLEAQVTAAQGATKEGSGIASNFPGQPTMEPVGRKRSRKAAKAQLEAQVRAAPAKKHTGKDPVRDECEERNPFTETREEDVTDEHGEREPFAEKDEHTGIHTMKLEHIAADIKKGLAAKREMIKIDKAAYRKTKNTIERALKKKQLKRQKRDYRHTRKLLNVLKEYIAEKQKDDEAEEAEAAAAAAEAAAAAEAAAAAAEVIVVEDEEEEEKEEEEEKEEEEEEGEEEGGGEEGEEGGGGGEGEETEEEEEEEEEEEEEEQIKAFQEKQKRWQQPTGVRSWRLREMKPLLEQLLKAAKDTKDNYCIISSSEESELDN

SEQ ID NO: 30543 - protein, 332 aa, Homo sapiens; identical to SEQ ID NO: 30542
  Payload ID: 5991
  Gene Symbol: FAM9A
  Gene Name: family with sequence similarity 9, member A
  Uniprot ID: Q8IZU1
  ENSP ID: ENSP00000440163

SEQ ID NO: 30544 - protein, 186 aa, Homo sapiens
  Payload ID: 5992
  Gene Symbol: FAM9B
  Gene Name: family with sequence similarity 9, member B
  Uniprot ID: Q8IZU0
  ENSP ID: ENSP00000318716
MAAWGKKHAGKDPVRDECEERNRFTETREEDVTDEHGEREPFAETDEHTGANTKKPEDTAEDLTAKRKRMKMDKTCSKTKNKSKHALRKKQLKRQKRDYIHSLKLLNVLEEYITDEQKEEEEEEGEEEELIRIFQEQQKKWQQYRSVRRERLKEMKLLRDQFVKALEDFEDLCDRVFSDEDSELDN

SEQ ID NO: 30545 - protein, 226 aa, Homo sapiens
  Payload ID: 5992
  Gene Symbol: FAM9B
  Gene Name: family with sequence similarity 9, member B
  Uniprot ID: Q8IZU0
  ENSP ID: ENSP00000354770
MPGFLSFLSVSLRSPGSGIASSFPGQPATDPVGRRAAKAQLEAQFMAAWGKKHAGKDPVRDECEERNRFTETREEDVTDEHGEREPFAETDEHTGANTKKPEDTAVGANNFKNYPVHIGVSSEQHILLDCSLSRQKRDYIHSLKLLNVLEEYITDEQKEEEEEEGEEEELIRIFQEQQKKWQQYRSVRRERLKEMKLLRDQFVKALEDFEDLCDRVFSDEDSELDN

SEQ ID NO: 30546 - protein, 186 aa, Homo sapiens; identical to SEQ ID NO: 30544
  Payload ID: 5992
  Gene Symbol: FAM9B
  Gene Name: family with sequence similarity 9, member B
  Uniprot ID: Q8IZU0
  ENSP ID: ENSP00000412606

SEQ ID NO: 30547 - protein, 90 aa, Homo sapiens
  Payload ID: 5992
  Gene Symbol: FAM9B
  Gene Name: family with sequence similarity 9, member B
  ENSP ID: ENSP00000431456
MKAKKAHPRVEYNKTSGNAFEEQFSLPTKVRGSPLASQDNQPRILWAGGLPRPSWRLNLWRPGGRSMQERIQSVMNVRKETVLQKQGRKM

SEQ ID NO: 30548 - protein, 166 aa, Homo sapiens
  Payload ID: 5993
  Gene Symbol: FAM9C
  Gene Name: family with sequence similarity 9, member C
  Uniprot ID: Q8IZT9
  ENSP ID: ENSP00000334430
MAAKDQLEVQVMAAQEMELAGKDPVSHEHEERKPVTETKEGDVTDEHGERGSFAETDEHTGVDTKELEDIAADIKEHLAAKRKRIEKIAKACSEIKNRIKNVLRTTQLKRQKRDYRISLKLPNVLEEFITDEQKDEEGDGEKEEQIKIFQEQQKRWQQDGKGTERD

SEQ ID NO: 30549 - protein, 166 aa, Homo sapiens; identical to SEQ ID NO: 30548
  Payload ID: 5993
  Gene Symbol: FAM9C
  Gene Name: family with sequence similarity 9, member C
  Uniprot ID: Q8IZT9
  ENSP ID: ENSP00000369999

SEQ ID NO: 30550 - protein, 126 aa, Homo sapiens
  Payload ID: 5993
  Gene Symbol: FAM9C
  Gene Name: family with sequence similarity 9, member C
  ENSP ID: ENSP00000409506
  MOD_RES (1)..(1): Any amino acid
XDVTDEHGERGSFAETDEHTGVDTKELEDIAADIKEHLAAKRKRIEKIAKACSEIKNRIKNVLRTTQLKRQKRDYRISLKLPNVLEEFITDEQKDEEGDGEKEEQIKIFQEQQKRWQQDGKGTERD

SEQ ID NO: 30551 - protein, 128 aa, Homo sapiens
  Payload ID: 5993
  Gene Symbol: FAM9C
  Gene Name: family with sequence similarity 9, member C
  ENSP ID: ENSP00000439185
MAAKDQLEVQVMAAQEMELAGKDPVSHEHEERKPVTETKEGDVTDEHGERGSFAETDEHTGVDTKELEDIAGMFYELFVVYENCFQPYNPYSRLYELVDDKTVLNAFFSYIAFNVICLIIFLTYFFNC

SEQ ID NO: 30552 - protein, 464 aa, Homo sapiens
  Payload ID: 5994
  Gene Symbol: FAM90A1
  Gene Name: family with sequence similarity 90, member A1
  Uniprot ID: Q86YD7
  ENSP ID: ENSP00000307798
MMARRDPKPGAKRLVRAQTLQKQRRAPVGPRAPPPDEEDPRLKCKNCEAFGHTARSTRCPMKCWKAALVPPNFGEKEGKENLKPWKPQVEANPGPLNKDKGEKEERPRPQDPQRKALLHIFSRKPPEKPLPNQKGSTESSDYLRVASGPMPVHTTSKRPRVDPVLSDRSATEMSDRGSVLASLSPLRKASLSSSSSLGPKERQTGAAADIPQTAVRHQGPEPLLVVKPTHSSPAGGCREVPQAASKTHGLLQAVSPQAQDKRPAVTSQPCPPAATHSLGLGSNLSFGPGAKRSAPAPIQACLNFPKKPRLGPFQIPESAIQGGELGAPENLQPPPAATELGPRTSPQTGTRTPAQVLSGDRQPPHSRPCLPTAQACTMSHHPAASHDGAQPLRVLFRRLENGRWSSSLLTAPSFHSPEKPGAFLAQSPHVSEKSEGPCVRVPPSVLYEDLQVPSSSEDSDSDLE

SEQ ID NO: 30553 - protein, 14 aa, Homo sapiens
  Payload ID: 5994
  Gene Symbol: FAM90A1
  Gene Name: family with sequence similarity 90, member A1
  ENSP ID: ENSP00000442315
MMARRDPKPGAKRL

SEQ ID NO: 30554 - protein, 464 aa, Homo sapiens; identical to SEQ ID NO: 30552
  Payload ID: 5994
  Gene Symbol: FAM90A1
  Gene Name: family with sequence similarity 90, member A1
  Uniprot ID: Q86YD7
  ENSP ID: ENSP00000445418

SEQ ID NO: 30555 - protein, 464 aa, Homo sapiens
  Payload ID: 5995
  Gene Symbol: FAM90A26
  Gene Name: family with sequence similarity 90, member A26
  ENSP ID: ENSP00000421131
MMACRDPKPGAKRLVRAQTLQKQRRAPVGPRAPPPDEEDPRLKCKNCGAFGHMARSTRCPMKCWKAALVPPTLGKKEGKENLKPWKPQVEANPGPLNKDKGEKEERPRQQDPQRKALLHIFSGKPPEKPLPNRKGSTESSVYLRVASGPMPVHTTSKRPRVDPVLADRSATEMSDRGSALASLSPLRKASLSSSSSLGPKERQTGAAADIPQPAVRHQGPEPLLVVKPTHSSPEGGCREVPQAASKTHGLLQAISPQAQDKRPAVTSQPCPPAATHSLGLGSNLSFGPGAKRPAQAPIQACLNFPKKPRLGPFQIPESAIQGGELGAPEYLQPPPATTELGPSTSPQMGRRTPAQVSSVDRQPPHSRPCLPTAQACTMSHHPATSHDGAQPLRVLFRRLENGRWSSSLLAAPSFHSPEKPGAFLAQSPHVSEKSEVPRVRVPPNVLYEDLQVSSSSEDSDSDLE

SEQ ID NO: 30556 - protein, 838 aa, Homo sapiens
  Payload ID: 5996
  Gene Symbol: FAM91A1
  Gene Name: family with sequence similarity 91, member A1
  Uniprot ID: Q658Y4
  ENSP ID: ENSP00000335082
MNIDVEFHIRHNYPWNKLPANVRQSLGNSQREYEKQVVLYSIRNQLRYRNNLVKHVKKDERRYYEELLKYSRDHLMLYPYHLSDIMVKGLRITPFSYYTGIMEDIMNSEKSYDSLPNFTAADCLRLLGIGRNQYIDLMNQCRSSKKFFRRKTARDLLPIKPVEIAIEAWWVVQAGYITEDDIKICTLPEKCAVDKIIDSGPQLSGSLDYNVVHSLYNKGFIYLDVPISDDSCIAVPPLEGFVMNRVQGDYFETLLYKIFVSIDEHTNVAELANVLEIDLSLVKNAVSMYCRLGFAHKKGQVINLDQLHSSWKNVPSVNRLKSTLDPQKMLLSWDGGESRSPVQEASSATDTDTNSQEDPADTASVSSLSLSTGHTKRIAFLFDSTLTAFLMMGNLSPNLKSHAVTMFEVGKLSDESLDSFLIELEKVQSTGEGEAQRYFDHALTLRNTILFLRHNKDLVAQTAQPDQPNYGFPLDLLRCESLLGLDPATCSRVLNKNYTLLVSMAPLTNEIRPVSSCTPQHIGPAIPEVSSVWFKLYIYHVTGQGPPSLLLSKGTRLRKLPDIFQSYDRLLITSWGHDPGVVPTSNVLTMLNDALTHSAVLIQGHGLHGIGETVHVPFPFDETELQGEFTRVNMGVHKALQILRNRVDLQHLCGYVTMLNASSQLADRKLSDASDERGEPDLASGSDVNGSTESFEMVIEEATIDSATKQTSGATTEADWVPLELCFGIPLFSSELNRKVCRKIAAHGLCRKESLQNLLHSSRKLSLQVLNFVHSFQEGASILDIHTEPSFSSLLSQSSCADMGVPLPAKNLIFKDGVLSEWSGRSPSSLLIANLHLQ

SEQ ID NO: 30557 - protein, 789 aa, Homo sapiens
  Payload ID: 5996
  Gene Symbol: FAM91A1
  Gene Name: family with sequence similarity 91, member A1
  ENSP ID: ENSP00000429491
MNIDVEFHIRHNYPWNKLPANVRQSLGNSQREYEKQVVLYSIRNQLRYRNNLVKHVKKDERRYYEELLKYSRDHLMLYPYHLSDIMVKGLRITPFSYYTGIMEDIMNSEKSYDSLPNFTAADCLRLLGIGRNQYIDLMNQCRSSKKFFRRKTARDLLPIKPVEIAIEAWWVVQAGYITEDDIKICTLPEKCAVDKIIDSGPQLSGSLDYNVVHSLYNKGFIYLDVPISDDSCIAVPPLEGFVMNRVQGDYFETLLYKIFVSIDEHTNVAELANVLEIDLSLVKNAVSMYCRLGFAHKKGQVINLDQLHSSWKNVPSVNRLKSTLDPQKMLLSWDGGESRSPVQEASSATDTDTNSQEDPADTASVSSLSLSTGHTKRIAFLFDSTLTAFLMMGNLSPNLKSHAVTMFEVGKLSDESLDSFLIELEKVQSTGEGEAQRYFDHALTLRNTILFLRHNKDLVAQTAQPDQPNYGFPLDLLRCESLLGLDPATCSRVLNKNYTLLVSMAPLTNEIRPVSSCTPQHIGPAIPEVSSVWFKLYIYHVTGQGPPSLLLSKGTRLRKLPDIFQSYDRLLITSWGHDPGVVPTSNVLTMLNDALTHSAVLIQGHGLHGIGETVHVPFPFDETELQGEFTRVNMGVHKALQILRNRVDLQHLCGYVTMLNASSQLADRKLSDASDERGEPDLASGSDVNGSTESFEMVIEEATIDSATKQTSGATTEADWVPLELCFGIPLFSSELNRKVCRKIAAHGLCRKESLQNLLHSSRKLSLQVLNFVHSFQVTKTKKSKWYLY

SEQ ID NO: 30558 - protein, 218 aa, Homo sapiens
  Payload ID: 5996
  Gene Symbol: FAM91A1
  Gene Name: family with sequence similarity 91, member A1
  ENSP ID: ENSP00000429784
MNIDVEFHIRHNYPWNKLPANVRQSLGNSQREYEKQVVLYSIRNQLRYRNNLVKHVKKDERRYYEELLKYSRDHLMLYPYHLSDIMVKGLRITPFSYYTGIMEDIMNSEKSYDSLPNFTAADCLRLLGIGRNQYIDLMNQCRSSKKFFRRKTARDLLPIKPVEIAIEAWWVVQAGYITEDDIKICTLPEKCAVDKIIDSGPQLSGSLDYNVVHSKWFV

SEQ ID NO: 30559 - protein, 114 aa, Homo sapiens
  Payload ID: 5996
  Gene Symbol: FAM91A1
  Gene Name: family with sequence similarity 91, member A1
  ENSP ID: ENSP00000430158
  MOD_RES (1)..(1): Any amino acid
XLYNKGFIYLDVPISDDSCIAVPPLEGFVMNRVQGDYFETLLYKIFVSIDEHTNVAELANVLEIDLSLVKNAVSMYCRLGFAHKKGQVINLDQLHSSWKNVPSVNRLKGGVSPC

SEQ ID NO: 30560 - protein, 60 aa, Homo sapiens
  Payload ID: 5996
  Gene Symbol: FAM91A1
  Gene Name: family with sequence similarity 91, member A1
  ENSP ID: ENSP00000431097
ADWVPLELCFGIPLFSSELNRKVCRKIAAHGLCRKESLQNLLHSSRKLSLQVLNFVHSFQ

SEQ ID NO: 30561 - protein, 163 aa, Homo sapiens
  Payload ID: 5997
  Gene Symbol: FAM92A1
  Gene Name: family with sequence similarity 92, member A1
  ENSP ID: ENSP00000352391
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVINFEEFSVKRRNIRNLYSLC

SEQ ID NO: 30562 - protein, 271 aa, Homo sapiens
  Payload ID: 5997
  Gene Symbol: FAM92A1
  Gene Name: family with sequence similarity 92, member A1
  Uniprot ID: A1XBS5
  ENSP ID: ENSP00000391671
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVISQAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQEAGWAATCQTLI

SEQ ID NO: 30563 - protein, 251 aa, Homo sapiens
  Payload ID: 5997
  Gene Symbol: FAM92A1
  Gene Name: family with sequence similarity 92, member A1
  Uniprot ID: A1XBS5
  ENSP ID: ENSP00000401774
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVISQAETELQRAAMDASRTSRHLEETINNFERQKMKDIKVFRNSLYAPDYSSRLDIVRANSKSPLQRSLSAKCVSGTGQVSTCRLRKDQQAEDDEDDELDVTEEENFLK

SEQ ID NO: 30564 - protein, 65 aa, Homo sapiens
  Payload ID: 5997
  Gene Symbol: FAM92A1
  Gene Name: family with sequence similarity 92, member A1
  ENSP ID: ENSP00000427991
MNFADEFAKLQDYRQAEVERLEAKVVEPLKTYGTIVKMKRDDLKATLTARNREAKQLTQLERTRQ

SEQ ID NO: 30565 - protein, 262 aa, Homo sapiens
  Payload ID: 5997
  Gene Symbol: FAM92A1
  Gene Name: family with sequence similarity 92, member A1
  Uniprot ID: A1XBS5
  ENSP ID: ENSP00000428065
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVISQAETELQRAAMDASRTSRHLEETINNFERQKMKDIKTIFSEFITIEMLFHGKALEVYTAAYQNIQNIDEDEDLERWSFAMLPRLVLNSWGSSDPPALASQSVRFSEILCMHQIIHLV

SEQ ID NO: 30566 - protein, 110 aa, Homo sapiens
  Payload ID: 5997
  Gene Symbol: FAM92A1
  Gene Name: family with sequence similarity 92, member A1
  ENSP ID: ENSP00000428446
MNFADEFAKLQDYRQAEVERLEAKVVEPLKTYGTIVKMKRDDLKATLTARNREAKQLTQLERTRQRNPSDRHVISQAETELQRAAMDASRTSRHLEETINNFERQKMKDI

SEQ ID NO: 30567 - protein, 37 aa, Homo sapiens
  Payload ID: 5997
  Gene Symbol: FAM92A1
  Gene Name: family with sequence similarity 92, member A1
  ENSP ID: ENSP00000428633
MKRDDLKATLTARNREAKQLTQLERTRQRNPSDRHVI

SEQ ID NO: 30568 - protein, 168 aa, Homo sapiens
  Payload ID: 5997
  Gene Symbol: FAM92A1
  Gene Name: family with sequence similarity 92, member A1
  ENSP ID: ENSP00000428739
MMRRTLENRNAQTKQLQTAVSNVEKHFGELCQIFAAYVRKTARLRDKADLLVNEINAYAATETPHLKLGLMNFADEFAKLQDYRQAEVLMNNDKKVERLEAKVVEPLKTYGTIVKMKRDDLKATLTARNREAKQLTQLERTRQRNPSDRHVISQAETELQRAAMDASR

SEQ ID NO: 30569 - protein, 134 aa, Homo sapiens
  Payload ID: 5997
  Gene Symbol: FAM92A1
  Gene Name: family with sequence similarity 92, member A1
  ENSP ID: ENSP00000428751
MDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSTCRLRKDQQAEDDEDDELDVTEEENFLK

SEQ ID NO: 30570 - protein, 134 aa, Homo sapiens; identical to SEQ ID NO: 30569
  Payload ID: 5997
  Gene Symbol: FAM92A1
  Gene Name: family with sequence similarity 92, member A1
  ENSP ID: ENSP00000428874

SEQ ID NO: 30571 - protein, 289 aa, Homo sapiens
  Payload ID: 5997
  Gene Symbol: FAM92A1
  Gene Name: family with sequence similarity 92, member A1
  Uniprot ID: A1XBS5
  ENSP ID: ENSP00000429367
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVISQAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSTCRLRKDQQAEDDEDDELDVTEEENFLK

SEQ ID NO: 30572 - protein, 132 aa, Homo sapiens
  Payload ID: 5997
  Gene Symbol: FAM92A1
  Gene Name: family with sequence similarity 92, member A1
  ENSP ID: ENSP00000429722
MMRRTLENRNAQTKQLQTAVSNVEKHFGELCQIFAAYVRKTARLRDKADLLVNEINAYAATETPHLKLGLMNFADEFAKLQDYRQAENLKREFQFSKNRMSIKKIELIIAIHTNLKSNHIWRYFWKNVEFLS

SEQ ID NO: 30573 - protein, 114 aa, Homo sapiens
  Payload ID: 5997
  Gene Symbol: FAM92A1
  Gene Name: family with sequence similarity 92, member A1
  ENSP ID: ENSP00000429955
MDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSKKPYSKGI

SEQ ID NO: 30574 - protein, 162 aa, Homo sapiens
  Payload ID: 5997
  Gene Symbol: FAM92A1
  Gene Name: family with sequence similarity 92, member A1
  ENSP ID: ENSP00000430069
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVIVSFEFGSLKKCLRYGVQK

SEQ ID NO: 30575 - protein, 79 aa, Homo sapiens
  Payload ID: 5997
  Gene Symbol: FAM92A1
  Gene Name: family with sequence similarity 92, member A1
  ENSP ID: ENSP00000430217
MNFADEFAKLQDYRQAEVERLEAKVVEPLKTYGTIVKMKRDDLKATLTARNREAKQLTQLERTRQRNPSDRHVISQAET

SEQ ID NO: 30576 - protein, 188 aa, Homo sapiens
  Payload ID: 5997
  Gene Symbol: FAM92A1
  Gene Name: family with sequence similarity 92, member A1
  ENSP ID: ENSP00000430812
  MOD_RES (1)..(1): Any amino acid
XKPVTARAQLPRAAHTGGLGNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVISQAETELQRAAMDASRTSRHLEETINNFERQKM

SEQ ID NO: 30577 - protein, 288 aa, Homo sapiens
  Payload ID: 5997
  Gene Symbol: FAM92A1
  Gene Name: family with sequence similarity 92, member A1
  ENSP ID: ENSP00000478089
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVLLAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSTCRLRKDQQAEDDEDDELDVTEEENFLK

SEQ ID NO: 30578 - protein, 304 aa, Homo sapiens
  Payload ID: 5998
  Gene Symbol: FAM92B
  Gene Name: family with sequence similarity 92, member B
  Uniprot ID: Q6ZTR7
  ENSP ID: ENSP00000443411
MNIVFSRDSQVRVMENTVANTEKYFGQFCSLLAAYTRKTARLRDKADQLVKQLIDFANSENPELRATMRGFAEDLAKVQDYRQAQVERLETKVVNPLKLYGAQIKQTRAEIKKFKHVQNHEIKQLEKLEKLRQKSPSDQQMISQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQGTLQVQLSRANEDPEHPHANHGRFSLCEWVVKGQPAHCVCGQGGHLMLPGHSL

SEQ ID NO: 30579 - protein, 205 aa, Homo sapiens
  Payload ID: 5998
  Gene Symbol: FAM92B
  Gene Name: family with sequence similarity 92, member B
  ENSP ID: ENSP00000478373
  MOD_RES (1)..(1): Any amino acid
XPLKLYGAQIKQTRAEIKKFKHVQNHEIKQLEKLEKLRQKSPSDQQMISQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQSAQSTIWSPGKEGEESEDNSMEEAPVEDLRALGQGPHKRELPTTVRRT

SEQ ID NO: 30580 - protein, 304 aa, Homo sapiens
  Payload ID: 5998
  Gene Symbol: FAM92B
  Gene Name: family with sequence similarity 92, member B
  ENSP ID: ENSP00000487117
MNIVFSRDSQVRVMENTVANTEKYFGQFCSLLAAYTRKTARLRDKADQLVKQLIDFANSENPELRATMRGFAEDLAKVQDYRQAQVERLETKVVNPLKLYGAQIKQTRAEIKKFKHVQNHEIKQLEKLEKLRQKSPSDQQMIGQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQGTLQVQLSRANEDPEHPHANHGRFSLCEWVVKGQPAHCVCGQGGHLMLPGHSL

SEQ ID NO: 30581 - protein, 160 aa, Homo sapiens
  Payload ID: 5999
  Gene Symbol: FAM96A
  Gene Name: family with sequence similarity 96, member A
  Uniprot ID: Q9H5X1
  ENSP ID: ENSP00000300030
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 30582 - protein, 102 aa, Homo sapiens
  Payload ID: 5999
  Gene Symbol: FAM96A
  Gene Name: family with sequence similarity 96, member A
  Uniprot ID: Q9H5X1
  ENSP ID: ENSP00000369644
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIVGNLHF

SEQ ID NO: 30583 - protein, 130 aa, Homo sapiens
  Payload ID: 5999
  Gene Symbol: FAM96A
  Gene Name: family with sequence similarity 96, member A
  ENSP ID: ENSP00000452953
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDSK

SEQ ID NO: 30584 - protein, 69 aa, Homo sapiens
  Payload ID: 5999
  Gene Symbol: FAM96A
  Gene Name: family with sequence similarity 96, member A
  ENSP ID: ENSP00000453210
MQRVSGLLSWTLSRVLWLSGLSEPGAARQPRIMEEKALEVYGWNAMAGSRLTATSAFWFQVILLPQSPK

SEQ ID NO: 30585 - protein, 102 aa, Homo sapiens; identical to SEQ ID NO: 30582
  Payload ID: 5999
  Gene Symbol: FAM96A
  Gene Name: family with sequence similarity 96, member A
  Uniprot ID: Q9H5X1
  ENSP ID: ENSP00000454079

SEQ ID NO: 30586 - protein, 163 aa, Homo sapiens
  Payload ID: 6000
  Gene Symbol: FAM96B
  Gene Name: family with sequence similarity 96, member B
  Uniprot ID: Q9Y3D0
  ENSP ID: ENSP00000387471
MVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAVNKQLADKERVAAALENTHLLEVVNQCLSARS

SEQ ID NO: 30587 - protein, 161 aa, Homo sapiens
  Payload ID: 6000
  Gene Symbol: FAM96B
  Gene Name: family with sequence similarity 96, member B
  ENSP ID: ENSP00000455028
  MOD_RES (1)..(1): Any amino acid
XVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAGPECVRLQQRRRQPGGGILRRQISEQATCR

SEQ ID NO: 30588 - protein, 106 aa, Homo sapiens
  Payload ID: 6000
  Gene Symbol: FAM96B
  Gene Name: family with sequence similarity 96, member B
  ENSP ID: ENSP00000462376
DSIDAREIFDLIRSINDPEHPLTLEELNVVEQVRVQVSDPESTVAVAFTPTIPHCSMATLIGLSIKVKLLRSLPQRFKMDVHITPGTHASEHAVNKQLADKERPGL

SEQ ID NO: 30589 - protein, 36 aa, Homo sapiens
  Payload ID: 6000
  Gene Symbol: FAM96B
  Gene Name: family with sequence similarity 96, member B
  ENSP ID: ENSP00000463700
MVGGGGVGGGLLENANPLIYQRSGERPVTAGEEDEQ

SEQ ID NO: 30590 - protein, 518 aa, Homo sapiens
  Payload ID: 6001
  Gene Symbol: FAM98A
  Gene Name: family with sequence similarity 98, member A
  Uniprot ID: Q8NCA5
  ENSP ID: ENSP00000238823
MECDLMETDILESLEDLGYKGPLLEDGALSQAVSAGASSPEFTKLCAWLVSELRVLCKLEENVQATNSPSEAEEFQLEVSGLLGEMNCPYLSLTSGDVTKRLLIQKNCLLLLTYLISELEAARMLCVNAPPKKAQEGGGSEVFQELKGICIALGMSKPPANITMFQFFSGIEKKLKETLAKVPPNHVGKPLLKKPMGPAHWEKIEAINQAIANEYEVRRKLLIKRLDVTVQSFGWSDRAKSQTEKLAKVYQPKRSVLSPKTTISVAHLLAARQDLSKILRTSSGSIREKTACAINKVLMGRVPDRGGRPNEIEPPPPEMPPWQKRQDGPQQQTGGRGGGRGGYEHSSYGGRGGHEQGGGRGGRGGYDHGGRGGGRGNKHQGGWTDGGSGGGGGYQDGGYRDSGFQPGGYHGGHSSGGYQGGGYGGFQTSSSYTGSGYQGGGYQQDNRYQDGGHHGDRGGGRGGRGGRGGRGGRAGQGGGWGGRGSQNYHQGGQFEQHFQHGGYQYNHSGFGQGRHYTS

SEQ ID NO: 30591 - protein, 312 aa, Homo sapiens
  Payload ID: 6001
  Gene Symbol: FAM98A
  Gene Name: family with sequence similarity 98, member A
  ENSP ID: ENSP00000384711
MECDLMETDILESLEDLGYKGPLLEDGALSQAVSAGASSPEFTKLCAWLVSELRVLCKLEENVQATNSPSEAEEFQLEVSGLLGEMNCPYLSLTSGDVTKRLLIQKNCLLLLTYLISELEAARMLCVNAPPKKAQEGGGSEVFQELKGICIALGMSKPPANITMFQFFSGIEKKLKETLAKVPPNHVGKPLLKKPMGPAHWEKIEAINQAIANEYEVRRKLLIKRLDVTVQSFGWSDRAKSQTEKLAKVYQPKRSVLSPKTTISVAHLLAARQDLSKILRTSSGSIREKTACAINKVIRVPLIFSKCIYFCS

SEQ ID NO: 30592 - protein, 68 aa, Homo sapiens
  Payload ID: 6001
  Gene Symbol: FAM98A
  Gene Name: family with sequence similarity 98, member A
  ENSP ID: ENSP00000398490
MECDLMETDILESLEDLGYKGPLLEDGALSQAVSAGASSPEFTKLCAWLVSELRVLCKLEENVQATNS

SEQ ID NO: 30593 - protein, 433 aa, Homo sapiens
  Payload ID: 6002
  Gene Symbol: FAM98B
  Gene Name: family with sequence similarity 98, member B
  Uniprot ID: Q52LJ0
  ENSP ID: ENSP00000380734
MRGPEPGPQPTMEGDVLDTLEALGYKGPLLEEQALTKAAEGGLSSPEFSELCIWLGSQIKSLCNLEESITSAGRDDLESFQLEISGFLKEMACPYSVLISGDIKDRLKKKEDCLKLLLFLSTELQASQILQNKKHKNSQLDKNSEVYQEVQAMFDTLGIPKSTTSDIPHMLNQVESKVKDILSKVQKNHVGKPLLKMDLNSEQAEQLERINDALSCEYECRRRMLMKRLDVTVQSFGWSDRAKVKTDDIARIYQPKRYALSPKTTITMAHLLAAREDLSKIIRTSSGTSREKTACAINKVLMGRVPDRGGRPNEIEPPPPEMPPWQKRQEGGGGRGGWGGGGGGGGRGGGGGGGGRGGWGGGGGGWGGGGGGGGGWGGGGGGGRGGFQGRGDYGGRGGYGGRGGYGGRGYGDPYGGGGGGGGGGGGGGGYRRY

SEQ ID NO: 30594 - protein, 330 aa, Homo sapiens
  Payload ID: 6002
  Gene Symbol: FAM98B
  Gene Name: family with sequence similarity 98, member B
  Uniprot ID: Q52LJ0
  ENSP ID: ENSP00000453166
MRGPEPGPQPTMEGDVLDTLEALGYKGPLLEEQALTKAAEGGLSSPEFSELCIWLGSQIKSLCNLEESITSAGRDDLESFQLEISGFLKEMACPYSVLISGDIKDRLKKKEDCLKLLLFLSTELQASQILQNKKHKNSQLDKNSEVYQEVQAMFDTLGIPKSTTSDIPHMLNQVESKVKDILSKVQKNHVGKPLLKMDLNSEQAEQLERINDALSCEYECRRRMLMKRLDVTVQSFGWSDRAKVKTDDIARIYQPKRYALSPKTTITMAHLLAAREDLSKIIRTSSGTSREKTACAINKVGVSFSTVENELMISYLMFLQILVYFSFMSW

SEQ ID NO: 30595 - protein, 101 aa, Homo sapiens
  Payload ID: 6002
  Gene Symbol: FAM98B
  Gene Name: family with sequence similarity 98, member B
  ENSP ID: ENSP00000453926
ISGDIKDRLKKKEDCLKLLLFLSTELQASQILQNKKHKNSQLDKNSEVYQEVQAMFDTLGIPKSTTSDIPHMLNQVESKVKDILSKIHMEEVVVVVVVVVE

SEQ ID NO: 30596 - protein, 349 aa, Homo sapiens
  Payload ID: 6003
  Gene Symbol: FAM98C
  Gene Name: family with sequence similarity 98, member C
  Uniprot ID: Q17RN3
  ENSP ID: ENSP00000252530
MEAVKAEAWEGAAVAQDLLALGYGGVPGAASRGASCPDFRGLCVRLAAELATLGALEQQREAGAEVLSAGDGPGAEEDFLRQLGSLLRELHCPDRALCGGDGAAALREPGAGLRLLRFLCSELQATRLLCLRSLLDPSPRPPLGEGVVEGAGMVQELDLTLQALGLPRPAPGTPASQLLQELHAKISELQPSLPPGSLQPLLSCSLDAPRWEALESLSQSLRDQYRCRRCLLLKRLDLTTSAFHWSDRAEAQGEAMRAVLIPIREVLTPESDISIAHVLAARADLSCLVPATSVAVRRGTCCAINKVLMGNVPDRGGRPNELEPPMPTWRSRREDGGPQCWGRKKKKKK

SEQ ID NO: 30597 - protein, 267 aa, Homo sapiens
  Payload ID: 6003
  Gene Symbol: FAM98C
  Gene Name: family with sequence similarity 98, member C
  Uniprot ID: Q17RN3
  ENSP ID: ENSP00000340348
MEAVKAEAWEGAAVAQDLLALGYGGVPGAASRGASCPDFRGLCVRLAAELATLGALEQQREAGAEVLSAGDGPGAEEDFLRQLGSLLRELHCPDRALCGGDGAAALREPGAGLRLLRFLCSELQATRLLCLRSLLDPSPRPPLGEGVVEGAGMVQELDLTLQALGLPRPAPGTPASQLLQELHAKEALESLSQSLRDQYRCRRCLLLKRLDLTTSAFHWSDRAEVLMGNVPDRGGRPNELEPPMPTWRSRREDGGPQCWGRKKKKKK

SEQ ID NO: 30598 - protein, 181 aa, Homo sapiens
  Payload ID: 6003
  Gene Symbol: FAM98C
  Gene Name: family with sequence similarity 98, member C
  ENSP ID: ENSP00000467878
  MOD_RES (1)..(1): Any amino acid
XGSVGGGRGGPGPAGSGVKGCAVRLVGAGRPGLPPGRGRKGIPSDIPAPSRCLGPHRYGGVPGAASRGASCPDFRGLCVRLAAELATLGALEQQREAGAEVLSAGDGPGAEEDFLRQLGSLLRELHCPDRALCGGDGAAALREPGAGLRLLRFLCSELQATRLLCLRSLLDPSPRPPLGEG

SEQ ID NO: 30599 - protein, 186 aa, Homo sapiens
  Payload ID: 6003
  Gene Symbol: FAM98C
  Gene Name: family with sequence similarity 98, member C
  ENSP ID: ENSP00000467974
MEAVKAEAWEGAAVAQDLLALGYGGVPGAASRGASCPDFRGLCVRLAAELATLGALEQQREAGAEVLSAGDGPGAEEDFLRQLGSLLRELHCPDRALCGGDGAAALREPGAGLRLLRPRRGHEGSADPNSRGSDPRIGHLHCTRSGCPSRPVLSRPSHQRGCPQRDLLCHQQGAYGQRSRPGGPPK

SEQ ID NO: 30600 - protein, 56 aa, Homo sapiens
  Payload ID: 6003
  Gene Symbol: FAM98C
  Gene Name: family with sequence similarity 98, member C
  ENSP ID: ENSP00000468553
  MOD_RES (1)..(1): Any amino acid
XPRWPRTCWLWGMEVSRGRRRGAPHAQTSGGCACGWRRSWRRWAPSSSSERRARRC

SEQ ID NO: 30601 - protein, 97 aa, Homo sapiens
  Payload ID: 6004
  Gene Symbol: FANCD2OS
  Gene Name: FANCD2 opposite strand
  ENSP ID: ENSP00000429589
GYQLWSPWTPLDESFQWLRHTTPTPSSKHPFKASPCFPHTPSDLEVQLCFQEVTLVLDSPFLESGRWSFTTLPKLVLNSWTQAMPWPRPPKVLGLQR

SEQ ID NO: 30602 - protein, 177 aa, Homo sapiens
  Payload ID: 6004
  Gene Symbol: FANCD2OS
  Gene Name: FANCD2 opposite strand
  Uniprot ID: Q96PS1
  ENSP ID: ENSP00000429608
MAGYQLWSPWTPLDESFQWLRHTTPTPSSKHPFKASPCFPHTPSDLEVQLCFQEVTLVLDSPFLESGVSPKLPCHTSELRTMNNKGLVRKPQPIRLSGVDSVFGRVITAQPPKWTGTFRVSDKSAFCKIISREHQWPIGLKEPQIQMTVTMCKQMLRSILLLYATYKKCTFALQHSK

SEQ ID NO: 30603 - protein, 177 aa, Homo sapiens; identical to SEQ ID NO: 30602
  Payload ID: 6004
  Gene Symbol: FANCD2OS
  Gene Name: FANCD2 opposite strand
  Uniprot ID: Q96PS1
  ENSP ID: ENSP00000429663

SEQ ID NO: 30604 - protein, 1017 aa, Homo sapiens
  Payload ID: 6005
  Gene Symbol: FAN1
  Gene Name: FANCD2/FANCI-associated nuclease 1
  Uniprot ID: Q9Y2M0
  ENSP ID: ENSP00000354497
MMSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRAKALAGQSVRICKGPRAVFSRILLLFSLTDSMEDEDAACGGQGQLSTVLLVNLGRMEFPSYTINRKTHIFQDRDDLIRYAAATHMLSDISSAMANGNWEEAKELAQCAKRDWNRLKNHPSLRCHEDLPLFLRCFTVGWIYTRILSRFVEILQRLHMYEEAVRELESLLSQRIYCPDSRGRWWDRLALNLHQHLKRLEPTIKCITEGLADPEVRTGHRLSLYQRAVRLRESPSCKKFKHLFQQLPEMAVQDVKHVTITGRLCPQRGMCKSVFVMEAGEAADPTTVLCSVEELALAHYRRSGFDQGIHGEGSTFSTLYGLLLWDIIFMDGIPDVFRNACQAFPLDLCTDSFFTSRRPALEARLQLIHDAPEESLRAWVAATWHEQEGRVASLVSWDRFTSLQQAQDLVSCLGGPVLSGVCRHLAADFRHCRGGLPDLVVWNSQSRHFKLVEVKGPNDRLSHKQMIWLAELQKLGAEVEVCHVVAVGAKSQSLS

SEQ ID NO: 30605 - protein, 533 aa, Homo sapiens
  Payload ID: 6005
  Gene Symbol: FAN1
  Gene Name: FANCD2/FANCI-associated nuclease 1
  Uniprot ID: Q9Y2M0
  ENSP ID: ENSP00000454223
MMSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRFCWLLLQ

SEQ ID NO: 30606 - protein, 533 aa, Homo sapiens; identical to SEQ ID NO: 30605
  Payload ID: 6005
  Gene Symbol: FAN1
  Gene Name: FANCD2/FANCI-associated nuclease 1
  Uniprot ID: Q9Y2M0
  ENSP ID: ENSP00000454544

SEQ ID NO: 30607 - protein, 430 aa, Homo sapiens
  Payload ID: 6005
  Gene Symbol: FAN1
  Gene Name: FANCD2/FANCI-associated nuclease 1
  ENSP ID: ENSP00000455573
MMSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSDLWTVPFKDRVWRKWKLSS

SEQ ID NO: 30608 - protein, 533 aa, Homo sapiens; identical to SEQ ID NO: 30605
  Payload ID: 6005
  Gene Symbol: FAN1
  Gene Name: FANCD2/FANCI-associated nuclease 1
  Uniprot ID: Q9Y2M0
  ENSP ID: ENSP00000455983

SEQ ID NO: 30609 - protein, 105 aa, Homo sapiens
  Payload ID: 6005
  Gene Symbol: FAN1
  Gene Name: FANCD2/FANCI-associated nuclease 1
  ENSP ID: ENSP00000457680
MRSYRIPLLVISSQESKTTGQKLYVRLFQRKLSWIKMTKLEYEEIALDLTPVIEELTNAGFLQTESELQELSEVLELLSAPELKSLAKTFHLVNPNGQKQQLVDA

SEQ ID NO: 30610 - protein, 1017 aa, Homo sapiens; identical to SEQ ID NO: 30604
  Payload ID: 6005
  Gene Symbol: FAN1
  Gene Name: FANCD2/FANCI-associated nuclease 1
  Uniprot ID: Q9Y2M0
  ENSP ID: ENSP00000484956

SEQ ID NO: 30611 - protein, 881 aa, Homo sapiens
  Payload ID: 6006
  Gene Symbol: FAAP100
  Gene Name: Fanconi anemia core complex associated protein 100
  Uniprot ID: Q0VG06
  ENSP ID: ENSP00000333283
MAGAAPRVRYLAGFCCPLGGLAAGKPRVLCHEAEVFLSTGSELVYVYDQEGGLLTAAFRFPDQVWHLELLAPRRLLYALCARRGLYCLSLDHPGRSRSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLAPPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQATQGSSAPDLRVQYLRQIHANHETLLREVQTLRDRLCTEDEASSCATAQRLLQVYRQLRHPSLILL

SEQ ID NO: 30612 - protein, 97 aa, Homo sapiens
  Payload ID: 6006
  Gene Symbol: FAAP100
  Gene Name: Fanconi anemia core complex associated protein 100
  ENSP ID: ENSP00000395348
MAGAAPRVRYLAGFCCPLGGLAAGKPRVLCHEAEVFLSTGSELVYVYDQEGGLLTAAFRFPDQVWHLELLAPRRLLYALCARRGLYCLSLDHPGRSR

SEQ ID NO: 30613 - protein, 530 aa, Homo sapiens
  Payload ID: 6006
  Gene Symbol: FAAP100
  Gene Name: Fanconi anemia core complex associated protein 100
  ENSP ID: ENSP00000399674
MHHPAPAWPRCGWCASHTWQISLGPRSTSFILCPLSSCGPRGEVRSDGWRQLPERLGVGGAGRNMPLGRGLTLWRGSTPTVCLSWSQARCLPGLSQDVAPGAVGVPPLPGVMSVLRRVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLAPPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQATQGSSAPDLRVQYLRQIHANHETLLREVQTLRDRLCTEDEASSCATAQRLLQVYRQLRHPSLILL

SEQ ID NO: 30614 - protein, 300 aa, Homo sapiens
  Payload ID: 6006
  Gene Symbol: FAAP100
  Gene Name: Fanconi anemia core complex associated protein 100
  ENSP ID: ENSP00000438149
MQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESA

SEQ ID NO: 30615 - protein, 172 aa, Homo sapiens
  Payload ID: 6006
  Gene Symbol: FAAP100
  Gene Name: Fanconi anemia core complex associated protein 100
  ENSP ID: ENSP00000443415
MHLALLSPLPSIKDSISSPNTFRAALARREEQGTDSRSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGAD

SEQ ID NO: 30616 - protein, 249 aa, Homo sapiens
  Payload ID: 6006
  Gene Symbol: FAAP100
  Gene Name: Fanconi anemia core complex associated protein 100
  ENSP ID: ENSP00000444241
MQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLN

SEQ ID NO: 30617 - protein, 110 aa, Homo sapiens
  Payload ID: 6006
  Gene Symbol: FAAP100
  Gene Name: Fanconi anemia core complex associated protein 100
  ENSP ID: ENSP00000459776
CPSDVLPEQEGVCLPLSRHTVDMLQCLRFPGLAPPHTRAPSPLGPTRDPVATFLETCREPGSQPAGPASLRAEYLPPSVASIKVSAELLRAALKDGHSVMFFKPIYGSVT

SEQ ID NO: 30618 - protein, 112 aa, Homo sapiens
  Payload ID: 6007
  Gene Symbol: FAAP20
  Gene Name: Fanconi anemia core complex associated protein 20
  Uniprot ID: Q6NZ36
  ENSP ID: ENSP00000367804
MEAARRPRLGLSRRRPRPAGGSPGAARSPLKSSLSDPRPFPGHPFRRTCGARAVPTGCFTGQEGTWNPPPGPCPSARHLIPAGPPGWSSSRLWRVPRPCAAAPCARRSSPPG

SEQ ID NO: 30619 - protein, 180 aa, Homo sapiens
  Payload ID: 6007
  Gene Symbol: FAAP20
  Gene Name: Fanconi anemia core complex associated protein 20
  Uniprot ID: Q6NZ36
  ENSP ID: ENSP00000367808
MEAARRPRLGLSRRRPRPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRLTQLDVDSHLAQCLAESTEDVTW

SEQ ID NO: 30620 - protein, 170 aa, Homo sapiens
  Payload ID: 6007
  Gene Symbol: FAAP20
  Gene Name: Fanconi anemia core complex associated protein 20
  Uniprot ID: Q6NZ36
  ENSP ID: ENSP00000383709
MEAARRPRLGLSRRRPRPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRYFNSRPHLCPAGS

SEQ ID NO: 30621 - protein, 189 aa, Homo sapiens
  Payload ID: 6007
  Gene Symbol: FAAP20
  Gene Name: Fanconi anemia core complex associated protein 20
  ENSP ID: ENSP00000383710
MEAARRPRLGLSRRRPRPAGGSPGAARSPLKSSLSDPRPFPGHPFRRTCGARAVPTGCFTGQEGTWNPPPGPCPSARHLIPAGPPGWSSSRLWRVPRPCAAAPCARRSSPPGTSTPAPTCVPLAPKLPPYVWVASEMWGRRHSRKKGIRGASTSSEHFIPQDATRSLSWRSRSVHRVLFPWKMCTLETA

SEQ ID NO: 30622 - protein, 193 aa, Homo sapiens
  Payload ID: 6007
  Gene Symbol: FAAP20
  Gene Name: Fanconi anemia core complex associated protein 20
  ENSP ID: ENSP00000405430
  MOD_RES (1)..(1): Any amino acid
XARRPRLGLSRRRPRPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRSKNSSGMRRHRSPKLAANNNNNKRKGRARWLTPVIPAL

SEQ ID NO: 30623 - protein, 195 aa, Homo sapiens
  Payload ID: 6007
  Gene Symbol: FAAP20
  Gene Name: Fanconi anemia core complex associated protein 20
  ENSP ID: ENSP00000409721
  MOD_RES (1)..(1): Any amino acid
XEAARRPRLGLSRRRPRPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRSKNSSGMRRHRSPKLAANNNNNKRKGRARWLTPVIPAL

SEQ ID NO: 30624 - protein, 195 aa, Homo sapiens
  Payload ID: 6007
  Gene Symbol: FAAP20
  Gene Name: Fanconi anemia core complex associated protein 20
  Uniprot ID: Q6NZ36
  ENSP ID: ENSP00000410450
MEAARRPRLGLSRRRPRPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRLTQLDVDSHLAQCLAESTEDVTCLSWMCKTLNDPGSQG

SEQ ID NO: 30625 - protein, 147 aa, Homo sapiens
  Payload ID: 6007
  Gene Symbol: FAAP20
  Gene Name: Fanconi anemia core complex associated protein 20
  ENSP ID: ENSP00000410740
  MOD_RES (1)..(1): Any amino acid
XAEAAAGVEPPEAAPGGREPRCGPEPTEVFTVGPKTFSWTPFPPDLWGPGRSYRLLHGAGGHLESPARSLPQRPAPDPCRAPRVEQQPSVEGAAALRSCPMCQKEFAPRSKNSSGMRRHRSPKLAANNNNNKRKGRARWLTPVIPAL

SEQ ID NO: 30626 - protein, 69 aa, Homo sapiens
  Payload ID: 6008
  Gene Symbol: FAAP24
  Gene Name: Fanconi anemia core complex associated protein 24
  ENSP ID: ENSP00000254262
MEKNPPDDTGPVHVPLGHIVANEKWRGSQLAQEMQDAAFFMSPKLIWWQEMATERGLFGLEIPIILKEL

SEQ ID NO: 30627 - protein, 120 aa, Homo sapiens
  Payload ID: 6008
  Gene Symbol: FAAP24
  Gene Name: Fanconi anemia core complex associated protein 24
  ENSP ID: ENSP00000465569
MSEQYFPALQKFTVLDLGMVLLPVASQMEASCLVIQLVQEQTKEPSKNPLLGKKRALLLSEPSLLRTVQQIPGVGKVKAPLLLQKFPSIQQLSNASIGELEQVVGQAVAQQIHAFFTQPR

SEQ ID NO: 30628 - protein, 120 aa, Homo sapiens; identical to SEQ ID NO: 30627
  Payload ID: 6008
  Gene Symbol: FAAP24
  Gene Name: Fanconi anemia core complex associated protein 24
  ENSP ID: ENSP00000465728

SEQ ID NO: 30629 - protein, 215 aa, Homo sapiens
  Payload ID: 6008
  Gene Symbol: FAAP24
  Gene Name: Fanconi anemia core complex associated protein 24
  Uniprot ID: Q9BTP7
  ENSP ID: ENSP00000466121
MEKNPPDDTGPVHVPLGHIVANEKWRGSQLAQEMQGKIKLIFEDGLTPDFYLSNRCCILYVTEADLVAGNGYRKRLVRVRNSNNLKGIVVVEKTRMSEQYFPALQKFTVLDLGMVLLPVASQMEASCLVIQLVQEQTKEPSKNPLLGKKRALLLSEPSLLRTVQQIPGVGKVKAPLLLQKFPSIQQLSNASIGELEQVVGQAVAQQIHAFFTQPR

SEQ ID NO: 30630 - protein, 215 aa, Homo sapiens; identical to SEQ ID NO: 30629
  Payload ID: 6008
  Gene Symbol: FAAP24
  Gene Name: Fanconi anemia core complex associated protein 24
  Uniprot ID: Q9BTP7
  ENSP ID: ENSP00000468475

SEQ ID NO: 30631 - protein, 1455 aa, Homo sapiens
  Payload ID: 6009
  Gene Symbol: FANCA
  Gene Name: Fanconi anemia, complementation group A
  Uniprot ID: O15360
  ENSP ID: ENSP00000373952
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPGKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 30632 - protein, 297 aa, Homo sapiens
  Payload ID: 6009
  Gene Symbol: FANCA
  Gene Name: Fanconi anemia, complementation group A
  Uniprot ID: O15360
  ENSP ID: ENSP00000373953
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRC

SEQ ID NO: 30633 - protein, 265 aa, Homo sapiens
  Payload ID: 6009
  Gene Symbol: FANCA
  Gene Name: Fanconi anemia, complementation group A
  ENSP ID: ENSP00000443409
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRC

SEQ ID NO: 30634 - protein, 302 aa, Homo sapiens
  Payload ID: 6009
  Gene Symbol: FANCA
  Gene Name: Fanconi anemia, complementation group A
  ENSP ID: ENSP00000443675
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRASAARS

SEQ ID NO: 30635 - protein, 109 aa, Homo sapiens
  Payload ID: 6009
  Gene Symbol: FANCA
  Gene Name: Fanconi anemia, complementation group A
  ENSP ID: ENSP00000454217
  MOD_RES (1)..(1): Any amino acid
XASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQRRW

SEQ ID NO: 30636 - protein, 240 aa, Homo sapiens
  Payload ID: 6009
  Gene Symbol: FANCA
  Gene Name: Fanconi anemia, complementation group A
  ENSP ID: ENSP00000454977
  MOD_RES (1)..(1): Any amino acid
XLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQAGQPRGTDNKSSSFSAAVNTSVPEKELLTRGRGNVKMPTLGHVGDMRIDSCLGHVPAWLAIQLDYFCQSPSPVV

SEQ ID NO: 30637 - protein, 158 aa, Homo sapiens
  Payload ID: 6009
  Gene Symbol: FANCA
  Gene Name: Fanconi anemia, complementation group A
  ENSP ID: ENSP00000455941
MSDSWVPNSASGQDPGGRRRAWAELLGRWARQAAGVGGVRPGTVSPVPRSLPARASAGRIPGRRARGAVRGGRPAGAARLPRTRPLLRLGGRPQPPPAGRSLLSRTPPPPAALSGGPGVRGLGLPSAQRPPLASRPRAPLPRALLGRLPRRPRWGRLR

SEQ ID NO: 30638 - protein, 114 aa, Homo sapiens
  Payload ID: 6009
  Gene Symbol: FANCA
  Gene Name: Fanconi anemia, complementation group A
  ENSP ID: ENSP00000455946
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSSLKAGGSRGYSLSRDGCL

SEQ ID NO: 30639 - protein, 101 aa, Homo sapiens
  Payload ID: 6009
  Gene Symbol: FANCA
  Gene Name: Fanconi anemia, complementation group A
  ENSP ID: ENSP00000455969
PHSQALQDVEKAIMVFEHTGNIPVTVMEASIFRRPYYVSHFLPALLTPRVLPKVPDSRVAFIESLKRWSLALLPRLECNCTILAHCKLCLLGWSNCPASAS

SEQ ID NO: 30640 - protein, 168 aa, Homo sapiens
  Payload ID: 6009
  Gene Symbol: FANCA
  Gene Name: Fanconi anemia, complementation group A
  ENSP ID: ENSP00000455974
  MOD_RES (1)..(1): Any amino acid
XFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDYWFSFSSSP

SEQ ID NO: 30641 - protein, 316 aa, Homo sapiens
  Payload ID: 6009
  Gene Symbol: FANCA
  Gene Name: Fanconi anemia, complementation group A
  ENSP ID: ENSP00000456443
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRCWYVPEGGLPECAAGRCLPN

SEQ ID NO: 30642 - protein, 153 aa, Homo sapiens
  Payload ID: 6009
  Gene Symbol: FANCA
  Gene Name: Fanconi anemia, complementation group A
  ENSP ID: ENSP00000456481
  MOD_RES (1)..(1): Any amino acid
XKKLDCEREESTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVA

SEQ ID NO: 30643 - protein, 182 aa, Homo sapiens
  Payload ID: 6009
  Gene Symbol: FANCA
  Gene Name: Fanconi anemia, complementation group A
  ENSP ID: ENSP00000456588
  MOD_RES (1)..(1): Any amino acid
XFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQDPPPPAFVCPLRQQLPGRTAHHCQMRAVLPLGQL

SEQ ID NO: 30644 - protein, 195 aa, Homo sapiens
  Payload ID: 6009
  Gene Symbol: FANCA
  Gene Name: Fanconi anemia, complementation group A
  ENSP ID: ENSP00000456608
AFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQAGARASPTSRGAPPSRRLLLPKNVPAQHADYGGHTSPVSLIPRCPKKSFSHVAELLADRGDCDPEVSAALQSRQQAAPDADLSQEPHLF

SEQ ID NO: 30645 - protein, 210 aa, Homo sapiens
  Payload ID: 6009
  Gene Symbol: FANCA
  Gene Name: Fanconi anemia, complementation group A
  ENSP ID: ENSP00000456722
VKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSGHG

SEQ ID NO: 30646 - protein, 125 aa, Homo sapiens
  Payload ID: 6009
  Gene Symbol: FANCA
  Gene Name: Fanconi anemia, complementation group A
  ENSP ID: ENSP00000456762
  MOD_RES (1)..(1): Any amino acid
XSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRCCI

SEQ ID NO: 30647 - protein, 1424 aa, Homo sapiens
  Payload ID: 6009
  Gene Symbol: FANCA
  Gene Name: Fanconi anemia, complementation group A
  Uniprot ID: O15360
  ENSP ID: ENSP00000456829
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPGKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQAGQPRGTDNKSSSFSAAVNTSVPEKELLTRGRAAG

SEQ ID NO: 30648 - protein, 51 aa, Homo sapiens
  Payload ID: 6009
  Gene Symbol: FANCA
  Gene Name: Fanconi anemia, complementation group A
  ENSP ID: ENSP00000456993
  MOD_RES (1)..(1): Any amino acid
XLSLWTHRTFREVLKEEDVHVGDRSFSCIMPRPESRVCVCSSGKNSSTWSW

SEQ ID NO: 30649 - protein, 214 aa, Homo sapiens
  Payload ID: 6009
  Gene Symbol: FANCA
  Gene Name: Fanconi anemia, complementation group A
  ENSP ID: ENSP00000457006
PSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDAAIREEAFLHVAVDMYLKLVQLFVAGDTSTVSPPAGRSLELKGQPRGTDNKSSSFSAAVNTSVPEKELLTRGRAAG

SEQ ID NO: 30650 - protein, 63 aa, Homo sapiens
  Payload ID: 6009
  Gene Symbol: FANCA
  Gene Name: Fanconi anemia, complementation group A
  ENSP ID: ENSP00000457027
GPSLSAPHVLGLAALAVHLGESRSALPEVDVGPPAPGAGLPVPALFDSLLTCRTRDSLFFCLK

SEQ ID NO: 30651 - protein, 41 aa, Homo sapiens
  Payload ID: 6009
  Gene Symbol: FANCA
  Gene Name: Fanconi anemia, complementation group A
  ENSP ID: ENSP00000457647
  MOD_RES (1)..(1): Any amino acid
XALDALAAGVQEESSTHKIVRCWYVPEGGLPECAAGRCLPN

SEQ ID NO: 30652 - protein, 77 aa, Homo sapiens
  Payload ID: 6009
  Gene Symbol: FANCA
  Gene Name: Fanconi anemia, complementation group A
  ENSP ID: ENSP00000457970
  MOD_RES (1)..(1): Any amino acid
XKKFQFLMFRLFSEARQPLSEEDVASLSWRPLHLPSADWQRAALSLWTHRTFREVLKEEDVHLVMVMCTCSPSHLRG

SEQ ID NO: 30653 - protein, 859 aa, Homo sapiens
  Payload ID: 6010
  Gene Symbol: FANCB
  Gene Name: Fanconi anemia, complementation group B
  Uniprot ID: Q8NB91
  ENSP ID: ENSP00000326819
MTSKQAMSSNEQERLLCYNGEVLVFQLSKGNFADKEPTKTPILHVRRMVFDRGTKVFVQKSTGFFTIKEENSHLKIMCCNCVSDFRTGINLPYIVIEKNKKNNVFEYFLLILHSTNKFEMRLSFKLGYEMKDGLRVLNGPLILWRHVKAFFFISSQTGKVVSVSGNFSSIQWAGEIENLGMVLLGLKECCLSEEECTQEPSKSDYAIWNTKFCVYSLESQEVLSDIYIIPPAYSSVVTYVHICATEIIKNQLRISLIALTRKNQLISFQNGTPKNVCQLPFGDPCAVQLMDSGGGNLFFVVSFISNNACAVWKESFQVAAKWEKLSLVLIDDFIGSGTEQVLLLFKDSLNSDCLTSFKITDLGKINYSSEPSDCNEDDLFEDKQENRYLVVPPLETGLKVCFSSFRELRQHLLLKEKIISKSYKALINLVQGKDDNTSSAEEKECLVPLCGEEENSVHILDEKLSDNFQDSEQLVEKIWYRVIDDSLVVGVKTTSSLKLSLNDVTLSLLMDQAHDSRFRLLKCQNRVIKLSTNPFPAPYLMPCEIGLEAKRVTLTPDSKKEESFVCEHPSKKECVQIITAVTSLSPLLTFSKFCCTVLLQIMERESGNCPKDRYVVCGRVFLSLEDLSTGKYLLTFPKKKPIEHMEDLFALLAAFHKSCFQITSPGYALNSMKVWLLEHMKCEIIKEFPEVYFCERPGSFYGTLFTWKQRTPFEGILIIYSRNQTVMFQCLHNLIRILPINCFLKNLKSGSENFLIDNMAFTLEKELVTLSSLSSAIAKHESNFMQRCEVSKGKSSVVAAALSDRRENIHPYRKELQREKKKMLQTNLKVSGALYREITLKVAEVQLKSDFAAQKLSNL

SEQ ID NO: 30654 - protein, 859 aa, Homo sapiens; identical to SEQ ID NO: 30653
  Payload ID: 6010
  Gene Symbol: FANCB
  Gene Name: Fanconi anemia, complementation group B
  Uniprot ID: Q8NB91
  ENSP ID: ENSP00000381378

SEQ ID NO: 30655 - protein, 818 aa, Homo sapiens
  Payload ID: 6010
  Gene Symbol: FANCB
  Gene Name: Fanconi anemia, complementation group B
  ENSP ID: ENSP00000397849
MTSKQAMSSNEQERLLCYNGEVLVFQLSKGNFADKEPTKTPILHVRRMVFDRGTKVFVQKSTGFFTIKEENSHLKIMCCNCVSDFRTGINLPYIVIEKNKKNNVFEYFLLILHSTNKFEMRLSFKLGYEMKDGLRVLNGPLILWRHVKAFFFISSQTGKVVSVSGNFSSIQWAGEIENLGMVLLGLKECCLSEEECTQEPSKSDYAIWNTKFCVYSLESQEVLSDIYIIPPAYSSVVTYVHICATEIIKNQLRISLIALTRKNQLISFQNGTPKNVCQLPFGDPCAVQLMDSGGGNLFFVVSFISNNACAVWKESFQVAAKWEKLSLVLIDDFIGSGTEQVLLLFKDSLNSDCLTSFKITDLGKINYSSEPSDCNEDDLFEDKQENRYLVVPPLETGLKVCFSSFRELRQHLLLKEKIISKSYKALINLVQGKDDNTSSAEEKECLVPLCGEEENSVHILDEKLSDNFQDSEQLVEKIWYRVIDDSLVVGVKTTSSLKLSLNDVTLSLLMDQAHDSRFRLLKCQNRVIKLSTNPFPAPYLMPCEIGLEAKRVTLTPDSKKEESFVCEHPSKKECVQIITAVTSLSPLLTFSKFCCTVLLQIMERESGNCPKDRYVVCGRVFLSLEDLSTGKYLLTFPKKKPIEHMEDLFALLAAFHKSCFQITSPGYALNSMKVWLLEHMKCEIIKEFPEVYFCERPGSFYGTLFTWKQRTPFEGILIIYSRNQTVMFQCLHNLIRILPINCFLKNLKSGSENFLIDNMAFTLEKELVTLSSLSSAIAKHESNFMQRCEVSKGKSSVVAAALSDRRENIHPYRKELQR

SEQ ID NO: 30656 - protein, 558 aa, Homo sapiens
  Payload ID: 6011
  Gene Symbol: FANCC
  Gene Name: Fanconi anemia, complementation group C
  Uniprot ID: Q00597
  ENSP ID: ENSP00000289081
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLLKNMVLSLASELRENHLNGFNTQRRMAPERVASLSRVCVPLITLTDVDPLVEALLICHGREPQEILQPEFFEAVNEAILLKKISLPMSAVVCLWLRHLPSLEKAMLHLFEKLISSERNCLRRIECFIKDSSLPQAACHPAIFRVVDEMFRCALLETDGALEIIATIQVFTQCFVEALEKASKQLRFALKTYFPYTSPSLAMVLLQDPQDIPRGHWLQTLKHISELLREAVEDQTHGSCGGPFESWFLFIHFGGWAEMVAEQLLMSAAEPPTALLWLLAFYYGPRDGRQQRAQTMVQVKAVLGHLLAMSRSSSLSAQDLQTVAGQGTDTDLRAPAQQLIRHLLLNFLLWAPGGHTIAWDVITLMAHTAEITHEIIGFLDQTLYRWNRLGIESPRSEKLARELLKELRTQV

SEQ ID NO: 30657 - protein, 558 aa, Homo sapiens; identical to SEQ ID NO: 30656
  Payload ID: 6011
  Gene Symbol: FANCC
  Gene Name: Fanconi anemia, complementation group C
  Uniprot ID: Q00597
  ENSP ID: ENSP00000364454

SEQ ID NO: 30658 - protein, 150 aa, Homo sapiens
  Payload ID: 6011
  Gene Symbol: FANCC
  Gene Name: Fanconi anemia, complementation group C
  ENSP ID: ENSP00000406908
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLL

SEQ ID NO: 30659 - protein, 492 aa, Homo sapiens
  Payload ID: 6011
  Gene Symbol: FANCC
  Gene Name: Fanconi anemia, complementation group C
  ENSP ID: ENSP00000479931
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLLKNMVLSLASELRENHLNGFNTQRRMAPERVASLSRVCVPLITLTDVDPLVEALLICHGREPQEILQPEFFEAVNEAILLKKISLPMSAVVCLWLRHLPSLEKAMLHLFEKLISSERNCLRRIECFIKDSSLPQAACHPAIFRVVDEMFRCALLETDGALEIIATIQVFTQCFVEALEKASKQLRFALKTYFPYTSPSLAMVLLQDPQDIPRGHWLQTLKHISELLREAVEDQTHGSCGGPFESWFLFIHFGGWAEMVAEQLLMSAAEPPTALLWLLAFYYGPRDGRQQRAQTMMAYVMATCRHGDLQPCGQRRSPVPTEVARDETLPAHSPAKRRPFFPKVI

SEQ ID NO: 30660 - protein, 1471 aa, Homo sapiens
  Payload ID: 6012
  Gene Symbol: FANCD2
  Gene Name: Fanconi anemia, complementation group D2
  Uniprot ID: Q9BXW9
  ENSP ID: ENSP00000287647
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEVSLQNPPESGTDGCILLIVLSWWSRTLPTYVYCQMLLCPFPFPP

SEQ ID NO: 30661 - protein, 1451 aa, Homo sapiens
  Payload ID: 6012
  Gene Symbol: FANCD2
  Gene Name: Fanconi anemia, complementation group D2
  Uniprot ID: Q9BXW9
  ENSP ID: ENSP00000373318
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEDGEEDEVSAGEKEQDSDESYDDSD

SEQ ID NO: 30662 - protein, 749 aa, Homo sapiens
  Payload ID: 6012
  Gene Symbol: FANCD2
  Gene Name: Fanconi anemia, complementation group D2
  ENSP ID: ENSP00000389936
  MOD_RES (1)..(1): Any amino acid
XLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRFMKRNSSTGTWLFETSVSSST

SEQ ID NO: 30663 - protein, 1451 aa, Homo sapiens; identical to SEQ ID NO: 30661
  Payload ID: 6012
  Gene Symbol: FANCD2
  Gene Name: Fanconi anemia, complementation group D2
  Uniprot ID: Q9BXW9
  ENSP ID: ENSP00000398754

SEQ ID NO: 30664 - protein, 241 aa, Homo sapiens
  Payload ID: 6012
  Gene Symbol: FANCD2
  Gene Name: Fanconi anemia, complementation group D2
  Uniprot ID: Q9BXW9
  ENSP ID: ENSP00000399354
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELRWINPLSSSK

SEQ ID NO: 30665 - protein, 38 aa, Homo sapiens
  Payload ID: 6012
  Gene Symbol: FANCD2
  Gene Name: Fanconi anemia, complementation group D2
  ENSP ID: ENSP00000402166
MVSKRRLSKSEDKESLTEDASKMGISLCHPGWSAVVIS

SEQ ID NO: 30666 - protein, 38 aa, Homo sapiens; identical to SEQ ID NO: 30665
  Payload ID: 6012
  Gene Symbol: FANCD2
  Gene Name: Fanconi anemia, complementation group D2
  ENSP ID: ENSP00000486945

SEQ ID NO: 30667 - protein, 536 aa, Homo sapiens
  Payload ID: 6013
  Gene Symbol: FANCE
  Gene Name: Fanconi anemia, complementation group E
  Uniprot ID: Q9HB96
  ENSP ID: ENSP00000229769
MATPDAGLPGAEGVEPAPWAQLEAPARLLLQALQAGPEGARRGLGVLRALGSRGWEPFDWGRLLEALCREEPVVQGPDGRLELKPLLLRLPRICQRNLMSLLMAVRPSLPESGLLSVLQIAQQDLAPDPDAWLRALGELLRRDLGVGTSMEGASPLSERCQRQLQSLCRGLGLGGRRLKSPQAPDPEEEENRDSQQPGKRRKDSEEEAASPEGKRVPKRLRCWEEEEDHEKERPEHKSLESLADGGSASPIKDQPVMAVKTGEDGSNLDDAKGLAESLELPKAIQDQLPRLQQLLKTLEEGLEGLEDAPPVELQLLHECSPSQMDLLCAQLQLPQLSDLGLLRLCTWLLALSPDLSLSNATVLTRSLFLGRILSLTSSASRLLTTALTSFCAKYTYPVCSALLDPVLQAPGTGPAQTELLCCLVKMESLEPDAQVLMLGQILELPWKEETFLVLQSLLERQVEMTPEKFSVLMEKLCKKGLAATTSMAYAKLMLTVMTKYQANITETQRLGLAMALEPNTTFLRKSLKAALKHLGP

SEQ ID NO: 30668 - protein, 374 aa, Homo sapiens
  Payload ID: 6014
  Gene Symbol: FANCF
  Gene Name: Fanconi anemia, complementation group F
  Uniprot ID: Q9NPI8
  ENSP ID: ENSP00000330875
MESLLQHLDRFSELLAVSSTTYVSTWDPATVRRALQWARYLRHIHRRFGRHGPIRTALERRLHNQWRQEGGFGRGPVPGLANFQALGHCDVLLSLRLLENRALGDAARYHLVQQLFPGPGVRDADEETLQESLARLARRRSAVHMLRFNGYRENPNLQEDSLMKTQAELLLERLQEVGKAEAERPARFLSSLWERLPQNNFLKVIAVALLQPPLSRRPQEELEPGIHKSPGEGSQVLVHWLLGNSEVFAAFCRALPAGLLTLVTSRHPALSPVYLGLLTDWGQRLHYDLQKGIWVGTESQDVPWEELHNRFQSLCQAPPPLKDKVLTALETCKAQDGDFEVPGLSIWTDLLLALRSGAFRKRQVLGLSAGLSSV

SEQ ID NO: 30669 - protein, 622 aa, Homo sapiens
  Payload ID: 6015
  Gene Symbol: FANCG
  Gene Name: Fanconi anemia, complementation group G
  Uniprot ID: O15287
  ENSP ID: ENSP00000367910
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWSLPLYLESYLSWIRPSDRDAFLEEFRTSLPKSCDL

SEQ ID NO: 30670 - protein, 215 aa, Homo sapiens
  Payload ID: 6015
  Gene Symbol: FANCG
  Gene Name: Fanconi anemia, complementation group G
  ENSP ID: ENSP00000409607
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQ

SEQ ID NO: 30671 - protein, 106 aa, Homo sapiens
  Payload ID: 6015
  Gene Symbol: FANCG
  Gene Name: Fanconi anemia, complementation group G
  ENSP ID: ENSP00000412793
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLEREWSL

SEQ ID NO: 30672 - protein, 1268 aa, Homo sapiens
  Payload ID: 6016
  Gene Symbol: FANCI
  Gene Name: Fanconi anemia, complementation group I
  Uniprot ID: Q9NVI1
  ENSP ID: ENSP00000300027
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNICAFLVMGVCEVLIEYNFSISSFSKNRFEDILSLFMCYKKLSDILNEKAGKAKTKMANKTSDSLLSMKFVSSLLTALFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 30673 - protein, 1328 aa, Homo sapiens
  Payload ID: 6016
  Gene Symbol: FANCI
  Gene Name: Fanconi anemia, complementation group I
  Uniprot ID: Q9NVI1
  ENSP ID: ENSP00000310842
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNICAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 30674 - protein, 1095 aa, Homo sapiens
  Payload ID: 6016
  Gene Symbol: FANCI
  Gene Name: Fanconi anemia, complementation group I
  ENSP ID: ENSP00000413249
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNICAFLVMGVCEVLIEYNFSISSFSKNRFEDILSLFMCYKKLSDILNEKAGKAKTKMANKTSDSLLSMKFVSSLLTALFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSVSPGVSELRRNSKKYGKAGEAVWFSSDPPVLFFHFLRTE

SEQ ID NO: 30675 - protein, 226 aa, Homo sapiens
  Payload ID: 6016
  Gene Symbol: FANCI
  Gene Name: Fanconi anemia, complementation group I
  ENSP ID: ENSP00000454371
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKVQM

SEQ ID NO: 30676 - protein, 145 aa, Homo sapiens
  Payload ID: 6016
  Gene Symbol: FANCI
  Gene Name: Fanconi anemia, complementation group I
  ENSP ID: ENSP00000454669
ECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVASNL

SEQ ID NO: 30677 - protein, 1090 aa, Homo sapiens [sequence omitted]

SEQ ID NO: 30678 - protein, 157 aa, Homo sapiens
  Payload ID: 6016
  Gene Symbol: FANCI
  Gene Name: Fanconi anemia, complementation group I
  ENSP ID: ENSP00000455735
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECK

SEQ ID NO: 30679 - protein, 125 aa, Homo sapiens
  Payload ID: 6016
  Gene Symbol: FANCI
  Gene Name: Fanconi anemia, complementation group I
  ENSP ID: ENSP00000456552
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGK

SEQ ID NO: 30680 - protein, 215 aa, Homo sapiens
  Payload ID: 6016
  Gene Symbol: FANCI
  Gene Name: Fanconi anemia, complementation group I
  ENSP ID: ENSP00000457029
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVY

SEQ ID NO: 30681 - protein, 252 aa, Homo sapiens
  Payload ID: 6016
  Gene Symbol: FANCI
  Gene Name: Fanconi anemia, complementation group I
  Uniprot ID: Q9NVI1
  ENSP ID: ENSP00000458024
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDE

SEQ ID NO: 30682 - protein, 375 aa, Homo sapiens
  Payload ID: 6017
  Gene Symbol: FANCL
  Gene Name: Fanconi anemia, complementation group L
  Uniprot ID: Q9NW38
  ENSP ID: ENSP00000233741
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 30683 - protein, 258 aa, Homo sapiens
  Payload ID: 6017
  Gene Symbol: FANCL
  Gene Name: Fanconi anemia, complementation group L
  ENSP ID: ENSP00000384046
MRDSSRLRLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 30684 - protein, 380 aa, Homo sapiens
  Payload ID: 6017
  Gene Symbol: FANCL
  Gene Name: Fanconi anemia, complementation group L
  Uniprot ID: Q9NW38
  ENSP ID: ENSP00000385021
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQVNSPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 30685 - protein, 347 aa, Homo sapiens
  Payload ID: 6017
  Gene Symbol: FANCL
  Gene Name: Fanconi anemia, complementation group L
  ENSP ID: ENSP00000386097
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 30686 - protein, 145 aa, Homo sapiens
  Payload ID: 6017
  Gene Symbol: FANCL
  Gene Name: Fanconi anemia, complementation group L
  ENSP ID: ENSP00000389448
MRDSSRLRLVYADTCFSTIKLKAEDASGREHLITLKLKAKYPAESPDYFVDFPVPFCASWTPQVNSPQSSLISIYSQFLAAIESLKAFWDVMDEIDEKTWVLEPEKPPRSATARRIALGNNVSINIEVDPRHPTMLPECFFLGAD

SEQ ID NO: 30687 - protein, 158 aa, Homo sapiens
  Payload ID: 6017
  Gene Symbol: FANCL
  Gene Name: Fanconi anemia, complementation group L
  ENSP ID: ENSP00000390991
MAVTEASLLRQCPLLLPQNRSKTVYEGFISAQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMD

SEQ ID NO: 30688 - protein, 288 aa, Homo sapiens
  Payload ID: 6017
  Gene Symbol: FANCL
  Gene Name: Fanconi anemia, complementation group L
  ENSP ID: ENSP00000400969
  MOD_RES (1)..(1): Any amino acid
XAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQVTDQAKMDVKIAVLPSSLISIYSQFLAAIESLKAFWDVMDEIDEKTWVLEPEKPPRSATARRIALGNNVSINIEVDPRHPTMLPECFFLGADHVVKPLGIKLSRNIHL

SEQ ID NO: 30689 - protein, 301 aa, Homo sapiens
  Payload ID: 6017
  Gene Symbol: FANCL
  Gene Name: Fanconi anemia, complementation group L
  ENSP ID: ENSP00000401280
MAVTEASLLRQCPLLLPQNRSKTVYEGFISAQEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECP

SEQ ID NO: 30690 - protein, 124 aa, Homo sapiens
  Payload ID: 6017
  Gene Symbol: FANCL
  Gene Name: Fanconi anemia, complementation group L
  ENSP ID: ENSP00000483263
NRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKDKVLLYCPGESHTPGLK

SEQ ID NO: 30691 - protein, 2048 aa, Homo sapiens
  Payload ID: 6018
  Gene Symbol: FANCM
  Gene Name: Fanconi anemia, complementation group M
  Uniprot ID: Q8IYD8
  ENSP ID: ENSP00000267430
MSGRQRTLFQTWGSSISRSSGTPGCSSGTERPQSPGSSKAPLPAAAEAQLESDDDVLLVAAYEAERQLCLENGGFCTSAGALWIYPTNCPVRDYQLHISRAALFCNTLVCLPTGLGKTFIAAVVMYNFYRWFPSGKVVFMAPTKPLVTQQIEACYQVMGIPQSHMAEMTGSTQASTRKEIWCSKRVLFLTPQVMVNDLSRGACPAAEIKCLVIDEAHKALGNYAYCQVVRELVKYTNHFRILALSATPGSDIKAVQQVITNLLIGQIELRSEDSPDILTYSHERKVEKLIVPLGEELAAIQKTYIQILESFARSLIQRNVLMRRDIPNLTKYQIILARDQFRKNPSPNIVGIQQGIIEGEFAICISLYHGYELLQQMGMRSLYFFLCGIMDGTKGMTRSKNELGRNEDFMKLYNHLECMFARTRSTSANGISAIQQGDKNKKFVYSHPKLKKLEEVVIEHFKSWNAENTTEKKRDETRVMIFSSFRDSVQEIAEMLSQHQPIIRVMTFVGHASGKSTKGFTQKEQLEVVKQFRDGGYNTLVSTCVGEEGLDIGEVDLIICFDSQKSPIRLVQRMGRTGRKRQGRIVIILSEGREERIYNQSQSNKRSIYKAISSNRQVLHFYQRSPRMVPDGINPKLHKMFITHGVYEPEKPSRNLQRKSSIFSYRDGMRQSSLKKDWFLSEEEFKLWNRLYRLRDSDEIKEITLPQVQFSSLQNEENKPAQESTTGIHQLSLSEWRLWQDHPLPTHQVDHSDRCRHFIGLMQMIEGMRHEEGECSYELEVESYLQMEDVTSTFIAPRNESNNLASDTFITHKKSSFIKNINQGSSSSVIESDEECAEIVKQTHIKPTKIVSLKKKVSKEIKKDQLKKENNHGIIDSVDNDRNSTVENIFQEDLPNDKRTSDTDEIAATCTINENVIKEPCVLLTECQFTNKSTSSLAGNVLDSGYNSFNDEKSVSSNLFLPFEEELYIVRTDDQFYNCHSLTKEVLANVERFLSYSPPPLSGLSDLEYEIAKGTALENLLFLPCAEHLRSDKCTCLLSHSAVNSQQNLELNSLKCINYPSEKSCLYDIPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSSKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANSSLQEISMYAQVTHQKAEEIYRYIHYVFDIQMLPNDLNQDRLKSDI

SEQ ID NO: 30692 - protein, 2022 aa, Homo sapiens
  Payload ID: 6018
  Gene Symbol: FANCM
  Gene Name: Fanconi anemia, complementation group M
  Uniprot ID: Q8IYD8
  ENSP ID: ENSP00000442493
MSGRQRTLFQTWGSSISRSSGTPGCSSGTERPQSPGSSKAPLPAAAEAQLESDDDVLLVAAYEAERQLCLENGGFCTSAGALWIYPTNCPVRDYQLHISRAALFCNTLVCLPTGLGKTFIAAVVMYNFYRWFPSGKVVFMAPTKPLVTQQIEACYQVMGIPQSHMAEMTGSTQASTRKEIWCSKRVLFLTPQVMVNDLSRGACPAAEIKCLVIDEAHKALGNYAYCQAVQQVITNLLIGQIELRSEDSPDILTYSHERKVEKLIVPLGEELAAIQKTYIQILESFARSLIQRNVLMRRDIPNLTKYQIILARDQFRKNPSPNIVGIQQGIIEGEFAICISLYHGYELLQQMGMRSLYFFLCGIMDGTKGMTRSKNELGRNEDFMKLYNHLECMFARTRSTSANGISAIQQGDKNKKFVYSHPKLKKLEEVVIEHFKSWNAENTTEKKRDETRVMIFSSFRDSVQEIAEMLSQHQPIIRVMTFVGHASGKSTKGFTQKEQLEVVKQFRDGGYNTLVSTCVGEEGLDIGEVDLIICFDSQKSPIRLVQRMGRTGRKRQGRIVIILSEGREERIYNQSQSNKRSIYKAISSNRQVLHFYQRSPRMVPDGINPKLHKMFITHGVYEPEKPSRNLQRKSSIFSYRDGMRQSSLKKDWFLSEEEFKLWNRLYRLRDSDEIKEITLPQVQFSSLQNEENKPAQESTTGIHQLSLSEWRLWQDHPLPTHQVDHSDRCRHFIGLMQMIEGMRHEEGECSYELEVESYLQMEDVTSTFIAPRNESNNLASDTFITHKKSSFIKNINQGSSSSVIESDEECAEIVKQTHIKPTKIVSLKKKVSKEIKKDQLKKENNHGIIDSVDNDRNSTVENIFQEDLPNDKRTSDTDEIAATCTINENVIKEPCVLLTECQFTNKSTSSLAGNVLDSGYNSFNDEKSVSSNLFLPFEEELYIVRTDDQFYNCHSLTKEVLANVERFLSYSPPPLSGLSDLEYEIAKGTALENLLFLPCAEHLRSDKCTCLLSHSAVNSQQNLELNSLKCINYPSEKSCLYDIPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSSKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANSSLQEISMYAQVTHQKAEEIYRYIHYVFDIQMLPNDLNQDRLKSDI

SEQ ID NO: 30693 - protein, 669 aa, Homo sapiens
  Payload ID: 6018
  Gene Symbol: FANCM
  Gene Name: Fanconi anemia, complementation group M
  Uniprot ID: Q8IYD8
  ENSP ID: ENSP00000450596
MSGRQRTLFQTWGSSISRSSGTPGCSSGTERPQSPGSSKAPLPAAAEAQLESDDDVLLVAAYEAERQLCLENGGFCTSAGALWIYPTNCPVRDYQLHISRAALFCNTLVCLPTGLGKTFIAAVVMYNFYRWFPSGKVVFMAPTKPLVTQQIEACYQVMGIPQSHMAEMTGSTQASTRKEIWCSKRVLFLTPQVMVNDLSRGACPAAEIKCLVIDEAHKALGNYAYCQVVRELVKYTNHFRILALSATPGSDIKAVQQVITNLLIGQIELRSEDSPDILTYSHERKVEKLIVPLGEELAAIQKTYIQILESFARSLIQRNVLMRRDIPNLTKYQIILARDQFRKNPSPNIVGIQQGIIEGEFAICISLYHGYELLQQMGMRSLYFFLCGIMDGTKGMTRSKNELGRNEDFMKLYNHLECMFARTRSTSANGISAIQQGDKNKKFVYSHPKLKKLEEVVIEHFKSWNAENTTEKKRDETRVMIFSSFRDSVQEIAEMLSQHQPIIRVMTFVGHASGKSTKGFTQKEQLEVVKQFRDGGYNTLVSTCVGEEGLDIGEVDLIICFDSQKSPIRLVQRMGRTGRKRQGRIVIILSEGREERIYNQSQSNKRSIYKAISSNRQVLHFYQRSPRMVPDGINPKLHKMFITHGVYEPEKPSRNLQRKSSIFSYRDGK

SEQ ID NO: 30694 - protein, 1016 aa, Homo sapiens
  Payload ID: 6018
  Gene Symbol: FANCM
  Gene Name: Fanconi anemia, complementation group M
  ENSP ID: ENSP00000450632
  MOD_RES (1)..(1): Any amino acid
XIPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSSKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKRFGHLALMFPMPSASAKRGAHGPQDLADYFGKESWDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANSSLQEISMYAQVTHQKAEEIYRYIHYVFDIQMLPNDLNQDRLKSDI

SEQ ID NO: 30695 - protein, 106 aa, Homo sapiens
  Payload ID: 6018
  Gene Symbol: FANCM
  Gene Name: Fanconi anemia, complementation group M
  ENSP ID: ENSP00000450797
VNKNKFIEQIQHLQSMFERICVIVEKDREKTGDTSRMFRRTKSYDSLLTTLIGAGIRILFSSCQEETADLLKELSLVEQRKNVGIHVPTVVNSNKTHFKKSPCMHK

SEQ ID NO: 30696 - protein, 135 aa, Homo sapiens
  Payload ID: 6018
  Gene Symbol: FANCM
  Gene Name: Fanconi anemia, complementation group M
  ENSP ID: ENSP00000451846
DGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTVPAKKKPQIC

SEQ ID NO: 30697 - protein, 1564 aa, Homo sapiens
  Payload ID: 6018
  Gene Symbol: FANCM
  Gene Name: Fanconi anemia, complementation group M
  ENSP ID: ENSP00000452033
LECMFARTRSTSANGISAIQQGDKNKKFVYSHPKLKKLEEVVIEHFKSWNAENTTEKKRDETRVMIFSSFRDSVQEIAEMLSQHQPIIRVMTFVGHASGKSTKGFTQKEQLEIYNQSQSNKRSIYKAISSNRQVLHFYQRSPRMVPDGINPKLHKMFITHGVYEPEKPSRNLQRKSSIFSYRDGMRQSSLKKDWFLSEEEFKLWNRLYRLRDSDEIKEITLPQVQFSSLQNEENKPAQESTTGIHQLSLSEWRLWQDHPLPTHQVDHSDRCRHFIGLMQMIEGMRHEEGECSYELEVESYLQMEDVTSTFIAPRNESNNLASDTFITHKKSSFIKNINQGSSSSVIESDEECAEIVKQTHIKPTKIVSLKKKVSKEIKKDQLKKENNHGIIDSVDNDRNSTVENIFQEDLPNDKRTSDTDEIAATCTINENVIKEPCVLLTECQFTNKSTSSLAGNVLDSGYNSFNDEKSVSSNLFLPFEEELYIVRTDDQFYNCHSLTKEVLANVERFLSYSPPPLSGLSDLEYEIAKGTALENLLFLPCAEHLRSDKCTCLLSHSAVNSQQNLELNSLKCINYPSEKSCLYDIPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSSKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANSSLQEISMYAQVTHQKAEEIYRYIHYVFDIQMLPNDLNQDRLKSDI

SEQ ID NO: 30698 - protein, 653 aa, Homo sapiens
  Payload ID: 6019
  Gene Symbol: FUBP1
  Gene Name: far upstream element (FUSE) binding protein 1
  Uniprot ID: Q96AE4
  ENSP ID: ENSP00000294623
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQCRFDPASIELAL

SEQ ID NO: 30699 - protein, 655 aa, Homo sapiens
  Payload ID: 6019
  Gene Symbol: FUBP1
  Gene Name: far upstream element (FUSE) binding protein 1
  ENSP ID: ENSP00000359803
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGFANHARSHHHLY

SEQ ID NO: 30700 - protein, 644 aa, Homo sapiens
  Payload ID: 6019
  Gene Symbol: FUBP1
  Gene Name: far upstream element (FUSE) binding protein 1
  Uniprot ID: Q96AE4
  ENSP ID: ENSP00000359804
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 30701 - protein, 232 aa, Homo sapiens
  Payload ID: 6019
  Gene Symbol: FUBP1
  Gene Name: far upstream element (FUSE) binding protein 1
  ENSP ID: ENSP00000402630
MADYSTVPPPSSGSAGGGGGGGGGGGVNDAFKDALQRARQIAAKIGGDAGTSLNSNDYGYGGQKRPLEDGDGSWTSPSSTTHWEGMPSPFKDQPDAKKVAPQNDSFGTQLPPMHQQQRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQ

SEQ ID NO: 30702 - protein, 572 aa, Homo sapiens
  Payload ID: 6020
  Gene Symbol: FUBP3
  Gene Name: far upstream element (FUSE) binding protein 3
  Uniprot ID: Q96I24
  ENSP ID: ENSP00000318177
MAELVQGQSAPVGMKAEGFVDALHRVRQIAAKIDSIPHLNNSTPLVDPSVYGYGVQKRPLDDGVGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSVGAPGGVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSHAASAAPQASSPPDYTMAWAEYYRQQVAFYGQTLGQAQAHSQEQ

SEQ ID NO: 30703 - protein, 419 aa, Homo sapiens
  Payload ID: 6021
  Gene Symbol: FDPS
  Gene Name: farnesyl diphosphate synthase
  Uniprot ID: P14324
  ENSP ID: ENSP00000349078
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 30704 - protein, 419 aa, Homo sapiens; identical to SEQ ID NO: 30703
  Payload ID: 6021
  Gene Symbol: FDPS
  Gene Name: farnesyl diphosphate synthase
  Uniprot ID: P14324
  ENSP ID: ENSP00000357340

SEQ ID NO: 30705 - protein, 353 aa, Homo sapiens
  Payload ID: 6021
  Gene Symbol: FDPS
  Gene Name: farnesyl diphosphate synthase
  Uniprot ID: P14324
  ENSP ID: ENSP00000391755
MNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 30706 - protein, 80 aa, Homo sapiens
  Payload ID: 6021
  Gene Symbol: FDPS
  Gene Name: farnesyl diphosphate synthase
  ENSP ID: ENSP00000478032
MNGDQNSDVYAQEKQDFVQHFSQIVRVLTEDEMGHPEIGDAIARLKESLALSPGLECDGVISACCNLHLLGSSDSPASAF

SEQ ID NO: 30707 - protein, 353 aa, Homo sapiens; identical to SEQ ID NO: 30705
  Payload ID: 6021
  Gene Symbol: FDPS
  Gene Name: farnesyl diphosphate synthase
  Uniprot ID: P14324
  ENSP ID: ENSP00000478235

SEQ ID NO: 30708 - protein, 274 aa, Homo sapiens
  Payload ID: 6021
  Gene Symbol: FDPS
  Gene Name: farnesyl diphosphate synthase
  ENSP ID: ENSP00000479557
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYL

SEQ ID NO: 30709 - protein, 353 aa, Homo sapiens; identical to SEQ ID NO: 30705
  Payload ID: 6021
  Gene Symbol: FDPS
  Gene Name: farnesyl diphosphate synthase
  Uniprot ID: P14324
  ENSP ID: ENSP00000480142

SEQ ID NO: 30710 - protein, 248 aa, Homo sapiens
  Payload ID: 6021
  Gene Symbol: FDPS
  Gene Name: farnesyl diphosphate synthase
  ENSP ID: ENSP00000483188
MDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 30711 - protein, 174 aa, Homo sapiens
  Payload ID: 6021
  Gene Symbol: FDPS
  Gene Name: farnesyl diphosphate synthase
  ENSP ID: ENSP00000484099
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDS

SEQ ID NO: 30712 - protein, 417 aa, Homo sapiens
  Payload ID: 6022
  Gene Symbol: FDFT1
  Gene Name: farnesyl-diphosphate farnesyltransferase 1
  Uniprot ID: P37268
  ENSP ID: ENSP00000220584
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 30713 - protein, 374 aa, Homo sapiens
  Payload ID: 6022
  Gene Symbol: FDFT1
  Gene Name: farnesyl-diphosphate farnesyltransferase 1
  Uniprot ID: P37268
  ENSP ID: ENSP00000390367
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 30714 - protein, 332 aa, Homo sapiens
  Payload ID: 6022
  Gene Symbol: FDFT1
  Gene Name: farnesyl-diphosphate farnesyltransferase 1
  Uniprot ID: P37268
  ENSP ID: ENSP00000431649
MTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 30715 - protein, 353 aa, Homo sapiens
  Payload ID: 6022
  Gene Symbol: FDFT1
  Gene Name: farnesyl-diphosphate farnesyltransferase 1
  Uniprot ID: P37268
  ENSP ID: ENSP00000431749
MRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 30716 - protein, 150 aa, Homo sapiens
  Payload ID: 6022
  Gene Symbol: FDFT1
  Gene Name: farnesyl-diphosphate farnesyltransferase 1
  ENSP ID: ENSP00000431852
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRM

SEQ ID NO: 30717 - protein, 353 aa, Homo sapiens; identical to SEQ ID NO: 30715
  Payload ID: 6022
  Gene Symbol: FDFT1
  Gene Name: farnesyl-diphosphate farnesyltransferase 1
  Uniprot ID: P37268
  ENSP ID: ENSP00000432331

SEQ ID NO: 30718 - protein, 45 aa, Homo sapiens
  Payload ID: 6022
  Gene Symbol: FDFT1
  Gene Name: farnesyl-diphosphate farnesyltransferase 1
  ENSP ID: ENSP00000432551
MEFVKCLGHPEEFYNLVRFRIGGKRKVMPKMDQITSHEGRFWNEV

SEQ ID NO: 30719 - protein, 67 aa, Homo sapiens
  Payload ID: 6022
  Gene Symbol: FDFT1
  Gene Name: farnesyl-diphosphate farnesyltransferase 1
  ENSP ID: ENSP00000433985
MEFVKCLGHPEEFYNLVRFRIGGKRKVMPKMDQTGGSWRARRRIARCWRTSQRSPLSLEIWLRNTKQ

SEQ ID NO: 30720 - protein, 410 aa, Homo sapiens
  Payload ID: 6022
  Gene Symbol: FDFT1
  Gene Name: farnesyl-diphosphate farnesyltransferase 1
  ENSP ID: ENSP00000434714
MEFVKCLGHPEEFYNLVRFRIGGKRKDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 30721 - protein, 51 aa, Homo sapiens
  Payload ID: 6022
  Gene Symbol: FDFT1
  Gene Name: farnesyl-diphosphate farnesyltransferase 1
  ENSP ID: ENSP00000434770
MEFVKCLGHPEEFYNLVRFRIGGKRKVMPKMDQQRSVHILSGSPSSGHTGR

SEQ ID NO: 30722 - protein, 113 aa, Homo sapiens
  Payload ID: 6022
  Gene Symbol: FDFT1
  Gene Name: farnesyl-diphosphate farnesyltransferase 1
  ENSP ID: ENSP00000435900
MRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKPQSLKTP

SEQ ID NO: 30723 - protein, 332 aa, Homo sapiens; identical to SEQ ID NO: 30714
  Payload ID: 6022
  Gene Symbol: FDFT1
  Gene Name: farnesyl-diphosphate farnesyltransferase 1
  Uniprot ID: P37268
  ENSP ID: ENSP00000436069

SEQ ID NO: 30724 - protein, 353 aa, Homo sapiens; identical to SEQ ID NO: 30715
  Payload ID: 6022
  Gene Symbol: FDFT1
  Gene Name: farnesyl-diphosphate farnesyltransferase 1
  Uniprot ID: P37268
  ENSP ID: ENSP00000444248

SEQ ID NO: 30725 - protein, 417 aa, Homo sapiens; identical to SEQ ID NO: 30712
  Payload ID: 6022
  Gene Symbol: FDFT1
  Gene Name: farnesyl-diphosphate farnesyltransferase 1
  Uniprot ID: P37268
  ENSP ID: ENSP00000480828

SEQ ID NO: 30726 - protein, 417 aa, Homo sapiens; identical to SEQ ID NO: 30712
  Payload ID: 6022
  Gene Symbol: FDFT1
  Gene Name: farnesyl-diphosphate farnesyltransferase 1
  Uniprot ID: P37268
  ENSP ID: ENSP00000481481

SEQ ID NO: 30727 - protein, 353 aa, Homo sapiens; identical to SEQ ID NO: 30715
  Payload ID: 6022
  Gene Symbol: FDFT1
  Gene Name: farnesyl-diphosphate farnesyltransferase 1
  Uniprot ID: P37268
  ENSP ID: ENSP00000484122

SEQ ID NO: 30728 - protein, 353 aa, Homo sapiens; identical to SEQ ID NO: 30715
  Payload ID: 6022
  Gene Symbol: FDFT1
  Gene Name: farnesyl-diphosphate farnesyltransferase 1
  Uniprot ID: P37268
  ENSP ID: ENSP00000485229

SEQ ID NO: 30729 - protein, 379 aa, Homo sapiens
  Payload ID: 6023
  Gene Symbol: FNTA
  Gene Name: farnesyltransferase, CAAX box, alpha
  Uniprot ID: P49354
  ENSP ID: ENSP00000303423
MAATEGVGEAAQGGEPGQPAQPPPQPHPPPPQQQHKEEMAAEAGEAVASPMDDGFVSLDSPSYVLYRDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 30730 - protein, 196 aa, Homo sapiens
  Payload ID: 6023
  Gene Symbol: FNTA
  Gene Name: farnesyltransferase, CAAX box, alpha
  ENSP ID: ENSP00000432411
GVGEAAQGGEPGQPAQPPPQPHPPPPQQQHKEEMAAEAGEAVASPMDDGDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFK

SEQ ID NO: 30731 - protein, 117 aa, Homo sapiens
  Payload ID: 6023
  Gene Symbol: FNTA
  Gene Name: farnesyltransferase, CAAX box, alpha
  ENSP ID: ENSP00000432892
MAATEGVGEAAQGGEPGQPAQPPPQPHPPPPQQQHKEEMAAEAGEAVASPMDDGFVSLDSPSYVLYRHFRRVLLKSLQKDLHEEMNYITAIIEEQPKNYQVWNLNFGIMSCSMWTNF

SEQ ID NO: 30732 - protein, 249 aa, Homo sapiens
  Payload ID: 6023
  Gene Symbol: FNTA
  Gene Name: farnesyltransferase, CAAX box, alpha
  ENSP ID: ENSP00000434430
MSVFRDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYL

SEQ ID NO: 30733 - protein, 67 aa, Homo sapiens
  Payload ID: 6023
  Gene Symbol: FNTA
  Gene Name: farnesyltransferase, CAAX box, alpha
  ENSP ID: ENSP00000435455
MAATEGVGEAAQGGEPGQPAQPPPQPHPPPPQQQHKEEMAAEAGEAVASPMDDGFVSLDSPSYVLYS

SEQ ID NO: 30734 - protein, 60 aa, Homo sapiens
  Payload ID: 6023
  Gene Symbol: FNTA
  Gene Name: farnesyltransferase, CAAX box, alpha
  ENSP ID: ENSP00000436998
MNYITAIIEEQPKNYQVWHHRRVLVEWLRDPSQELEFIADILNQDAKNYHAWQHRQWVIQ

SEQ ID NO: 30735 - protein, 67 aa, Homo sapiens; identical to SEQ ID NO: 30733
  Payload ID: 6023
  Gene Symbol: FNTA
  Gene Name: farnesyltransferase, CAAX box, alpha
  ENSP ID: ENSP00000437208

SEQ ID NO: 30736 - protein, 228 aa, Homo sapiens
  Payload ID: 6023
  Gene Symbol: FNTA
  Gene Name: farnesyltransferase, CAAX box, alpha
  ENSP ID: ENSP00000473479
MNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 30737 - protein, 437 aa, Homo sapiens
  Payload ID: 6024
  Gene Symbol: FNTB
  Gene Name: farnesyltransferase, CAAX box, beta
  Uniprot ID: P49356
  ENSP ID: ENSP00000246166
MASPSSFTYYCPPSSSPVWSEPLYSLRPEHARERLQDDSVETVTSIEQAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 30738 - protein, 490 aa, Homo sapiens
  Payload ID: 6025
  Gene Symbol: FAF1
  Gene Name: Fas (TNFRSF6) associated factor 1
  ENSP ID: ENSP00000360843
MILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 30739 - protein, 650 aa, Homo sapiens
  Payload ID: 6025
  Gene Symbol: FAF1
  Gene Name: Fas (TNFRSF6) associated factor 1
  Uniprot ID: Q9UNN5
  ENSP ID: ENSP00000379457
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 30740 - protein, 464 aa, Homo sapiens
  Payload ID: 6025
  Gene Symbol: FAF1
  Gene Name: Fas (TNFRSF6) associated factor 1
  ENSP ID: ENSP00000434929
MLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDIPGLSRMGKHACSRSLYIHFMFFILILKTWIISCF

SEQ ID NO: 30741 - protein, 1092 aa, Homo sapiens
  Payload ID: 6026
  Gene Symbol: FBF1
  Gene Name: Fas (TNFRSF6) binding factor 1
  ENSP ID: ENSP00000324292
  MOD_RES (1)..(1): Any amino acid
XSLLGDDVFSTMAGLEEADAEVSGISEADPQALLQAMKDLDGMDADILGLKKSNSAPSKKAAKDPGKGELPNHPKPAGGAIPTKKSLPSPSSSGHQNRRFSSEDLEDPLRGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 30742 - protein, 1133 aa, Homo sapiens
  Payload ID: 6026
  Gene Symbol: FBF1
  Gene Name: Fas (TNFRSF6) binding factor 1
  Uniprot ID: Q8TES7
  ENSP ID: ENSP00000465132
MAPKTKKGCKVTLPEKPVKLASHTRDTTGVSQMFPSSKARTKSLLGDDVFSTMAGLEEADAEVSGISEADPQALLQAMKDLDGMDADILGLKKSNSAPSKKAAKDPGKGELPNHPKPAGGAIPTKKSLPSPSSSGHQNRRFSSEDLEDPLRGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 30743 - protein, 88 aa, Homo sapiens
  Payload ID: 6026
  Gene Symbol: FBF1
  Gene Name: Fas (TNFRSF6) binding factor 1
  ENSP ID: ENSP00000465937
LNEQSRLLEQERWRVTAEQSKAESMQRALEEQRKVTAQQMAMERAELERAKSALLEEQKSVMLKCGEERRRLAAEWAEFSAQQKLRAG

SEQ ID NO: 30744 - protein, 1148 aa, Homo sapiens
  Payload ID: 6026
  Gene Symbol: FBF1
  Gene Name: Fas (TNFRSF6) binding factor 1
  ENSP ID: ENSP00000467004
  MOD_RES (1)..(1): Any amino acid
XAPKTKKGCKGSIDDFLGDLLGDDMTLPEKPVKLASHTRDTTGVSQMFPSSKARTKSLLGDDVFSTMAGLEEADAEVSGISEADPQALLQAMKDLDGMDADILGLKKSNSAPSKKAAKDPGKGELPNHPKPAGGAIPTKKSLPSPSSSGHQNRRFSSEDLEDPLRGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 30745 - protein, 150 aa, Homo sapiens
  Payload ID: 6026
  Gene Symbol: FBF1
  Gene Name: Fas (TNFRSF6) binding factor 1
  ENSP ID: ENSP00000467481
  MOD_RES (1)..(1): Any amino acid
XRESSVPVTPSVPPPASQHSTPAGLPPSRAKPPTEGAGSPAKASQASKLRASKEEKEDWLSHALSRKKSQGLAREQHAGTSEGLHLAGTAGHPPSGSLTWAFCHLHLERCLSSANLSPAHKGLSTQLLEGVLEQLHEKDRVSGLVSRGPL

SEQ ID NO: 30746 - protein, 92 aa, Homo sapiens
  Payload ID: 6026
  Gene Symbol: FBF1
  Gene Name: Fas (TNFRSF6) binding factor 1
  ENSP ID: ENSP00000468699
RARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 30747 - protein, 50 aa, Homo sapiens
  Payload ID: 6026
  Gene Symbol: FBF1
  Gene Name: Fas (TNFRSF6) binding factor 1
  ENSP ID: ENSP00000475294
MVGRVQSKMHGKRTCLPSCIPKDLDCMQHSGGWAARTRMETLEKSDRRWH

SEQ ID NO: 30748 - protein, 1133 aa, Homo sapiens
  Payload ID: 6026
  Gene Symbol: FBF1
  Gene Name: Fas (TNFRSF6) binding factor 1
  Uniprot ID: Q8TES7
  ENSP ID: ENSP00000486708
MAPKTKKGCKVTLPEKPVKLASHTRDTTGVSQMFPSSKARTKSLLGDDVFSTMAGLEEADAEVSGISEADPQALLQAMKDLDGMDADILGLKKSNSAPSKKAAKDPGKGELPNHPKPAGGAIPTKKSLPSPSSSGHQNRRFSSEDLEDPLRGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 30749 - protein, 208 aa, Homo sapiens
  Payload ID: 6027
  Gene Symbol: FADD
  Gene Name: Fas (TNFRSF6)-associated via death domain
  Uniprot ID: Q13158
  ENSP ID: ENSP00000301838
MDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 30750 - protein, 213 aa, Homo sapiens
  Payload ID: 6028
  Gene Symbol: FAIM
  Gene Name: Fas apoptotic inhibitory molecule
  Uniprot ID: Q9NVQ4
  ENSP ID: ENSP00000342805
MLLPFIRTLPLLCYNHLLVSPDSATLSPPYSLEKMTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRKEGIIHTLIVDNREIPEIAS

SEQ ID NO: 30751 - protein, 201 aa, Homo sapiens
  Payload ID: 6028
  Gene Symbol: FAIM
  Gene Name: Fas apoptotic inhibitory molecule
  Uniprot ID: Q9NVQ4
  ENSP ID: ENSP00000353775
MASGDDSPIFEDDESPPYSLEKMTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRKEGIIHTLIVDNREIPEIAS

SEQ ID NO: 30752 - protein, 179 aa, Homo sapiens
  Payload ID: 6028
  Gene Symbol: FAIM
  Gene Name: Fas apoptotic inhibitory molecule
  Uniprot ID: Q9NVQ4
  ENSP ID: ENSP00000376754
MTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRKEGIIHTLIVDNREIPEIAS

SEQ ID NO: 30753 - protein, 179 aa, Homo sapiens; identical to SEQ ID NO: 30752
  Payload ID: 6028
  Gene Symbol: FAIM
  Gene Name: Fas apoptotic inhibitory molecule
  Uniprot ID: Q9NVQ4
  ENSP ID: ENSP00000376755

SEQ ID NO: 30754 - protein, 179 aa, Homo sapiens; identical to SEQ ID NO: 30752
  Payload ID: 6028
  Gene Symbol: FAIM
  Gene Name: Fas apoptotic inhibitory molecule
  Uniprot ID: Q9NVQ4
  ENSP ID: ENSP00000417642

SEQ ID NO: 30755 - protein, 128 aa, Homo sapiens
  Payload ID: 6028
  Gene Symbol: FAIM
  Gene Name: Fas apoptotic inhibitory molecule
  ENSP ID: ENSP00000420543
MTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLE

SEQ ID NO: 30756 - protein, 316 aa, Homo sapiens
  Payload ID: 6029
  Gene Symbol: FAIM2
  Gene Name: Fas apoptotic inhibitory molecule 2
  Uniprot ID: Q9BWQ8
  ENSP ID: ENSP00000321951
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 30757 - protein, 266 aa, Homo sapiens
  Payload ID: 6029
  Gene Symbol: FAIM2
  Gene Name: Fas apoptotic inhibitory molecule 2
  ENSP ID: ENSP00000446771
MVYTSHYKSPGRRPLKTHPTVTYWRVNEGSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFL

SEQ ID NO: 30758 - protein, 208 aa, Homo sapiens
  Payload ID: 6029
  Gene Symbol: FAIM2
  Gene Name: Fas apoptotic inhibitory molecule 2
  ENSP ID: ENSP00000447715
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKNPSHPQVYTILLIQLLVTLAVVALFTFCDPVKDYVQANPGWYWASYAVFFATYLTLACCSGPRRHFPWNLILLTVFTLSMAYLTGMLSSSTSPPARACSSCFS

SEQ ID NO: 30759 - protein, 111 aa, Homo sapiens
  Payload ID: 6029
  Gene Symbol: FAIM2
  Gene Name: Fas apoptotic inhibitory molecule 2
  ENSP ID: ENSP00000449360
MKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLAC

SEQ ID NO: 30760 - protein, 248 aa, Homo sapiens
  Payload ID: 6029
  Gene Symbol: FAIM2
  Gene Name: Fas apoptotic inhibitory molecule 2
  ENSP ID: ENSP00000449711
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQ

SEQ ID NO: 30761 - protein, 145 aa, Homo sapiens
  Payload ID: 6029
  Gene Symbol: FAIM2
  Gene Name: Fas apoptotic inhibitory molecule 2
  ENSP ID: ENSP00000449957
  MOD_RES (1)..(1): Any amino acid
XYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYFLALDTQLLMGNRRHSLSPEEYIFGAL

SEQ ID NO: 30762 - protein, 270 aa, Homo sapiens
  Payload ID: 6029
  Gene Symbol: FAIM2
  Gene Name: Fas apoptotic inhibitory molecule 2
  Uniprot ID: Q9BWQ8
  ENSP ID: ENSP00000450132
MKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 30763 - protein, 445 aa, Homo sapiens
  Payload ID: 6030
  Gene Symbol: FAF2
  Gene Name: Fas associated factor family member 2
  Uniprot ID: Q96CS3
  ENSP ID: ENSP00000261942
MAAPEERDLTQEQTEKLLQFQDLTGIESMDQCRHTLEQHNWNIEAAVQDRLNEQEGVPSVFNPPPSRPLQVNTADHRIYSYVVSRPQPRGLLGWGYYLIMLPFRFTYYTILDIFRFALRFIRPDPRSRVTDPVGDIVSFMHSFEEKYGRAHPVFYQGTYSQALNDAKRELRFLLVYLHGDDHQDSDEFCRNTLCAPEVISLINTRMLFWACSTNKPEGYRVSQALRENTYPFLAMIMLKDRRMTVVGRLEGLIQPDDLINQLTFIMDANQTYLVSERLEREERNQTQVLRQQQDEAYLASLRADQEKERKKREERERKRRKEEEVQQQKLAEERRRQNLQEEKERKLECLPPEPSPDDPESVKIIFKLPNDSRVERRFHFSQSLTVIHDFLFSLKESPEKFQIEANFPRRVLPCIPSEEWPNPPTLQEAGLSHTEVLFVQDLTDE

SEQ ID NO: 30764 - protein, 48 aa, Homo sapiens
  Payload ID: 6030
  Gene Symbol: FAF2
  Gene Name: Fas associated factor family member 2
  ENSP ID: ENSP00000424146
MDLTGIESMDQCRHTLEQHNWNIEAAVQDRLNEQEGVPSVFNPPPSRP

SEQ ID NO: 30765 - protein, 233 aa, Homo sapiens [sequence omitted]

SEQ ID NO: 30766 - protein, 220 aa, Homo sapiens
  Payload ID: 6031
  Gene Symbol: FAS
  Gene Name: Fas cell surface death receptor
  Uniprot ID: P25445
  ENSP ID: ENSP00000347426
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPMLT

SEQ ID NO: 30767 - protein, 335 aa, Homo sapiens
  Payload ID: 6031
  Gene Symbol: FAS
  Gene Name: Fas cell surface death receptor
  Uniprot ID: P25445
  ENSP ID: ENSP00000347979
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 30768 - protein, 314 aa, Homo sapiens
  Payload ID: 6031
  Gene Symbol: FAS
  Gene Name: Fas cell surface death receptor
  Uniprot ID: P25445
  ENSP ID: ENSP00000349896
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 30769 - protein, 103 aa, Homo sapiens
  Payload ID: 6031
  Gene Symbol: FAS
  Gene Name: Fas cell surface death receptor
  Uniprot ID: P25445
  ENSP ID: ENSP00000420975
MLGIWTLLPLVLTSVARLSSKSVNAQVTDINSKGLELRKTVTTVETQNLEGLHHDGQFCHKPCPPDVNMESSRNAHSPATPSAKRKDPDLTWGGFVFFFCQFH

SEQ ID NO: 30770 - protein, 132 aa, Homo sapiens
  Payload ID: 6031
  Gene Symbol: FAS
  Gene Name: Fas cell surface death receptor
  Uniprot ID: P25445
  ENSP ID: ENSP00000422453
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHDVNMESSRNAHSPATPSAKRK

SEQ ID NO: 30771 - protein, 149 aa, Homo sapiens
  Payload ID: 6031
  Gene Symbol: FAS
  Gene Name: Fas cell surface death receptor
  Uniprot ID: P25445
  ENSP ID: ENSP00000423755
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHDVNMESSRNAHSPATPSAKRKDPDLTWGGFVFFFCQFH

SEQ ID NO: 30772 - protein, 86 aa, Homo sapiens
  Payload ID: 6031
  Gene Symbol: FAS
  Gene Name: Fas cell surface death receptor
  Uniprot ID: P25445
  ENSP ID: ENSP00000424113
MLGIWTLLPLVLTSVARLSSKSVNAQVTDINSKGLELRKTVTTVETQNLEGLHHDGQFCHKPCPPDVNMESSRNAHSPATPSAKRK

SEQ ID NO: 30773 - protein, 149 aa, Homo sapiens; identical to SEQ ID NO: 30771
  Payload ID: 6031
  Gene Symbol: FAS
  Gene Name: Fas cell surface death receptor
  Uniprot ID: P25445
  ENSP ID: ENSP00000425159

SEQ ID NO: 30774 - protein, 216 aa, Homo sapiens
  Payload ID: 6031
  Gene Symbol: FAS
  Gene Name: Fas cell surface death receptor
  ENSP ID: ENSP00000477997
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESNFKS

SEQ ID NO: 30775 - protein, 254 aa, Homo sapiens
  Payload ID: 6031
  Gene Symbol: FAS
  Gene Name: Fas cell surface death receptor
  ENSP ID: ENSP00000484575
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVREWCQ

SEQ ID NO: 30776 - protein, 244 aa, Homo sapiens
  Payload ID: 6031
  Gene Symbol: FAS
  Gene Name: Fas cell surface death receptor
  ENSP ID: ENSP00000485876
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYHHYCWSHDTKSS

SEQ ID NO: 30777 - protein, 127 aa, Homo sapiens
  Payload ID: 6032
  Gene Symbol: FASLG
  Gene Name: Fas ligand (TNF superfamily, member 6)
  Uniprot ID: P48023
  ENSP ID: ENSP00000344739
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELREATPVHPLKKRS

SEQ ID NO: 30778 - protein, 281 aa, Homo sapiens
  Payload ID: 6032
  Gene Symbol: FASLG
  Gene Name: Fas ligand (TNF superfamily, member 6)
  Uniprot ID: P48023
  ENSP ID: ENSP00000356694
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 30779 - protein, 549 aa, Homo sapiens
  Payload ID: 6033
  Gene Symbol: FASTK
  Gene Name: Fas-activated serine/threonine kinase
  Uniprot ID: Q14296
  ENSP ID: ENSP00000297532
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 30780 - protein, 408 aa, Homo sapiens
  Payload ID: 6033
  Gene Symbol: FASTK
  Gene Name: Fas-activated serine/threonine kinase
  Uniprot ID: Q14296
  ENSP ID: ENSP00000324817
MRRPRGEPGPRAPRPTEGATCAGPGESCFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 30781 - protein, 522 aa, Homo sapiens
  Payload ID: 6033
  Gene Symbol: FASTK
  Gene Name: Fas-activated serine/threonine kinase
  Uniprot ID: Q14296
  ENSP ID: ENSP00000418516
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLREARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 30782 - protein, 465 aa, Homo sapiens [sequence omitted]

SEQ ID NO: 30783 - protein, 392 aa, Homo sapiens
  Payload ID: 6034
  Gene Symbol: FEZ1
  Gene Name: fasciculation and elongation protein zeta 1 (zygin I)
  Uniprot ID: Q99689
  ENSP ID: ENSP00000278919
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEIHEKEEEEFNEKSENDSGINEEPLLTADQVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 30784 - protein, 104 aa, Homo sapiens
  Payload ID: 6034
  Gene Symbol: FEZ1
  Gene Name: fasciculation and elongation protein zeta 1 (zygin I)
  Uniprot ID: Q99689
  ENSP ID: ENSP00000393425
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEE

SEQ ID NO: 30785 - protein, 104 aa, Homo sapiens; identical to SEQ ID NO: 30784
  Payload ID: 6034
  Gene Symbol: FEZ1
  Gene Name: fasciculation and elongation protein zeta 1 (zygin I)
  Uniprot ID: Q99689
  ENSP ID: ENSP00000431521

SEQ ID NO: 30786 - protein, 79 aa, Homo sapiens
  Payload ID: 6034
  Gene Symbol: FEZ1
  Gene Name: fasciculation and elongation protein zeta 1 (zygin I)
  ENSP ID: ENSP00000434803
MEAPLVSLDEEFEDLRPSCSEDPEEKPQCFYGSSPHHLEDPSLSELENFSSEIISFKSMEDLVNEFDEKLNVCFRNYNA

SEQ ID NO: 30787 - protein, 207 aa, Homo sapiens
  Payload ID: 6034
  Gene Symbol: FEZ1
  Gene Name: fasciculation and elongation protein zeta 1 (zygin I)
  ENSP ID: ENSP00000463116
  MOD_RES (1)..(1): Any amino acid
XVWDALTDNYIPSLSEDWRDPNIEALNGNCSDTETYSIHREVFSNGLMDRINQLPVSLEPTQGRRPEVCLIHEKEEEEFNEKSENDSGINEEPLLTADQVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVL

SEQ ID NO: 30788 - protein, 182 aa, Homo sapiens
  Payload ID: 6035
  Gene Symbol: FEZ2
  Gene Name: fasciculation and elongation protein zeta 2 (zygin II)
  ENSP ID: ENSP00000305843
MMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDSEKVPSLLTDYILKVLCPT

SEQ ID NO: 30789 - protein, 245 aa, Homo sapiens
  Payload ID: 6035
  Gene Symbol: FEZ2
  Gene Name: fasciculation and elongation protein zeta 2 (zygin II)
  ENSP ID: ENSP00000350685
MPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDSEKVPSLLTDYI

SEQ ID NO: 30790 - protein, 380 aa, Homo sapiens
  Payload ID: 6035
  Gene Symbol: FEZ2
  Gene Name: fasciculation and elongation protein zeta 2 (zygin II)
  Uniprot ID: Q9UHY8
  ENSP ID: ENSP00000368547
MAADGDWQDFYEFQEPARSLLDQENCNASPEPGAEAGAEAGGGADGFPAPACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTRFSMEGISNVIQNGLRHTFGNSGGEKQYLTTVIPYEKKNGPPSVEDLQILTKILRAMKEDSEKVPSLLTDYILKVLCPT

SEQ ID NO: 30791 - protein, 353 aa, Homo sapiens
  Payload ID: 6035
  Gene Symbol: FEZ2
  Gene Name: fasciculation and elongation protein zeta 2 (zygin II)
  Uniprot ID: Q9UHY8
  ENSP ID: ENSP00000385112
MAADGDWQDFYEFQEPARSLLDQENCNASPEPGAEAGAEAGGGADGFPAPACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDSEKVPSLLTDYILKVLCPT

SEQ ID NO: 30792 - protein, 305 aa, Homo sapiens
  Payload ID: 6035
  Gene Symbol: FEZ2
  Gene Name: fasciculation and elongation protein zeta 2 (zygin II)
  ENSP ID: ENSP00000390985
MAADGDWQDFYEFQEPARSLLDQENCNASPEPGAEAGAEAGGGADGFPAPACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTFFVP

SEQ ID NO: 30793 - protein, 138 aa, Homo sapiens
  Payload ID: 6035
  Gene Symbol: FEZ2
  Gene Name: fasciculation and elongation protein zeta 2 (zygin II)
  ENSP ID: ENSP00000395619
  MOD_RES (1)..(1): Any amino acid
XILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDSEKVPSLLTDYILKEPIATICEQMKP

SEQ ID NO: 30794 - protein, 70 aa, Homo sapiens
  Payload ID: 6035
  Gene Symbol: FEZ2
  Gene Name: fasciculation and elongation protein zeta 2 (zygin II)
  ENSP ID: ENSP00000396982
  MOD_RES (1)..(1): Any amino acid
XSNVIQNGLRHTFGNSGGEKQYLTTVIPYEKKNGPPSVEDLQILTKILRAMKEDSEKVPSLLTDYILKGL

SEQ ID NO: 30795 - protein, 63 aa, Homo sapiens
  Payload ID: 6035
  Gene Symbol: FEZ2
  Gene Name: fasciculation and elongation protein zeta 2 (zygin II)
  ENSP ID: ENSP00000410879
MPVDWKSSHTRTLHLLTLNLSEKGVSDSLLFDTSDDEELREQLDMHSIIVSCVNDEPLFTADQ

SEQ ID NO: 30796 - protein, 183 aa, Homo sapiens
  Payload ID: 6035
  Gene Symbol: FEZ2
  Gene Name: fasciculation and elongation protein zeta 2 (zygin II)
  ENSP ID: ENSP00000415325
  MOD_RES (1)..(1): Any amino acid
XTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKKRRLLVNNPVPLFLSPLFGNFKSGKQLSVLRAMKEDSEKVPSLLTDYILKVLCPT

SEQ ID NO: 30797 - protein, 493 aa, Homo sapiens
  Payload ID: 6036
  Gene Symbol: FSCN1
  Gene Name: fascin actin-bundling protein 1
  Uniprot ID: Q16658
  ENSP ID: ENSP00000371798
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 30798 - protein, 137 aa, Homo sapiens
  Payload ID: 6036
  Gene Symbol: FSCN1
  Gene Name: fascin actin-bundling protein 1
  ENSP ID: ENSP00000383982
MDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQ

SEQ ID NO: 30799 - protein, 132 aa, Homo sapiens
  Payload ID: 6036
  Gene Symbol: FSCN1
  Gene Name: fascin actin-bundling protein 1
  ENSP ID: ENSP00000404506
MDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSS

SEQ ID NO: 30800 - protein, 120 aa, Homo sapiens
  Payload ID: 6036
  Gene Symbol: FSCN1
  Gene Name: fascin actin-bundling protein 1
  ENSP ID: ENSP00000409967
MDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCR

SEQ ID NO: 30801 - protein, 516 aa, Homo sapiens
  Payload ID: 6037
  Gene Symbol: FSCN2
  Gene Name: fascin actin-bundling protein 2, retinal
  Uniprot ID: O14926
  ENSP ID: ENSP00000334665
MPTNGLHQVLKIQFGLVNDTDRYLTAESFGFKVNASAPSLKRKQTWVLEPDPGQGTAVLLRSSHLGRYLSAEEDGRVACEAEQPGRDCRFLVLPQPDGRWVLRSEPHGRFFGGTEDQLSCFATAVSPAELWTVHLAIHPQAHLLSVSRRRYVHLCPREDEMAADGDKPWGVDALLTLIFRSRRYCLKSCDSRYLRSDGRLVWEPEPRACYTLEFKAGKLAFKDCDGHYLAPVGPAGTLKAGRNTRPGKDELFDLEESHPQVVLVAANHRYVSVRQGVNVSANQDDELDHETFLMQIDQETKKCTFYSSTGGYWTLVTHGGIHATATQVSANTMFEMEWRGRRVALKASNGRYVCMKKNGQLAAISDFVGPPPRPAWTGKVAGGAAQQTLSPPGKDEEFTLKLINRPILVLRGLDGFVCHHRGSNQLDTNRSVYDVFHLSFSDGAYRIRGRDGGFWYTGSHGSVCSDGERAEDFVFEFRERGRLAIRARSGKYLRGGASGLLRADADAPAGTALWEY

SEQ ID NO: 30802 - protein, 492 aa, Homo sapiens
  Payload ID: 6037
  Gene Symbol: FSCN2
  Gene Name: fascin actin-bundling protein 2, retinal
  Uniprot ID: O14926
  ENSP ID: ENSP00000388716
MPTNGLHQVLKIQFGLVNDTDRYLTAESFGFKVNASAPSLKRKQTWVLEPDPGQGTAVLLRSSHLGRYLSAEEDGRVACEAEQPGRDCRFLVLPQPDGRWVLRSEPHGRFFGGTEDQLSCFATAVSPAELWTVHLAIHPQAHLLSVSRRRYVHLCPREDEMAADGDKPWGVDALLTLIFRSRRYCLKSCDSRYLRSDGRLVWEPEPRACYTLEFKAGKLAFKDCDGHYLAPVGPAGTLKAGRNTRPGKDELFDLEESHPQVVLVAANHRYVSVRQGVNVSANQDDELDHETFLMQIDQETKKCTFYSSTGGYWTLVTHGGIHATATQVSANTMFEMEWRGRRVALKASNGRYVCMKKNGQLAAISDFVGKDEEFTLKLINRPILVLRGLDGFVCHHRGSNQLDTNRSVYDVFHLSFSDGAYRIRGRDGGFWYTGSHGSVCSDGERAEDFVFEFRERGRLAIRARSGKYLRGGASGLLRADADAPAGTALWEY

SEQ ID NO: 30803 - protein, 498 aa, Homo sapiens
  Payload ID: 6038
  Gene Symbol: FSCN3
  Gene Name: fascin actin-bundling protein 3, testicular
  Uniprot ID: Q9NQT6
  ENSP ID: ENSP00000265825
MDETEWIHRHPKAEDLRVGLISWAGTYLTFEACKNTVTATAKSLGRRQTWEILVSNEHETQAVVRLKSVQGLYLLCECDGTVCYGRPRTSHHGCFLLRFHRNSKWTLQCLISGRYLESNGKDVFCTSHVLSAYHMWTPRPALHVHVILYSPIHRCYARADPTMGRIWVDAAVPCLEECGFLLHFRDGCYHLETSTHHFLSHVDRLFSQPSSQTAFHMQVRPGGLVALCDGEGGMLYPQGTHLLLGMGCNPMRGEEWFILQHCPTWVSLRSKTGRFISVIYDGEVRAASERLNRMSLFQFECDSESPTVQLRSANGYYLSQRRHRAVMADGHPLESDTFFRMHWNCGRIILQSCRGRFLGIAPNSLLMANVILPGPNEEFGILFANRSFLVLRGRYGYVGSSSGHDLIQCNQDQPDRIHLLPCRPGIYHFQAQGGSFWSITSFGTFRPWGKFALNFCIELQGSNLLTVLAPNGFYMRADQSGTLLADSEDITRECIWEF

SEQ ID NO: 30804 - protein, 79 aa, Homo sapiens
  Payload ID: 6038
  Gene Symbol: FSCN3
  Gene Name: fascin actin-bundling protein 3, testicular
  ENSP ID: ENSP00000402472
MDETEWIHRHPKAEDLRVGLISWAGTYLTFEACKNTVTATAKSLGRRQHRVVVSERREVESTGWLCQKEEKWRAQVDHS

SEQ ID NO: 30805 - protein, 147 aa, Homo sapiens
  Payload ID: 6038
  Gene Symbol: FSCN3
  Gene Name: fascin actin-bundling protein 3, testicular
  ENSP ID: ENSP00000473531
MWTPRPALHVHVILYSPIHRCYARADPTMGRIWVDAAVPCLEECGFLLHFRDGCYHLETSTHHFLSHVDRLFSQPSSQTAFHMQVRPGGLVALCDGEGGMLYPQGTHLLLGMGCNPMRGEEWFILQHCPTWVSLRSKTGRFISVIYD

SEQ ID NO: 30806 - protein, 253 aa, Homo sapiens
  Payload ID: 6039
  Gene Symbol: FASTKD1
  Gene Name: FAST kinase domains 1
  ENSP ID: ENSP00000396769
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYK

SEQ ID NO: 30807 - protein, 276 aa, Homo sapiens
  Payload ID: 6039
  Gene Symbol: FASTKD1
  Gene Name: FAST kinase domains 1
  ENSP ID: ENSP00000399551
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYK

SEQ ID NO: 30808 - protein, 847 aa, Homo sapiens
  Payload ID: 6039
  Gene Symbol: FASTKD1
  Gene Name: FAST kinase domains 1
  Uniprot ID: Q53R41
  ENSP ID: ENSP00000400513
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHMYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 30809 - protein, 804 aa, Homo sapiens
  Payload ID: 6039
  Gene Symbol: FASTKD1
  Gene Name: FAST kinase domains 1
  Uniprot ID: Q53R41
  ENSP ID: ENSP00000403229
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHMYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLESIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 30810 - protein, 104 aa, Homo sapiens
  Payload ID: 6039
  Gene Symbol: FASTKD1
  Gene Name: FAST kinase domains 1
  ENSP ID: ENSP00000408667
MGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYK

SEQ ID NO: 30811 - protein, 710 aa, Homo sapiens
  Payload ID: 6040
  Gene Symbol: FASTKD2
  Gene Name: FAST kinase domains 2
  Uniprot ID: Q9NYY8
  ENSP ID: ENSP00000236980
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEKRLMFSHPAFNQLCEHMMREAKIMQYKYLLFSLHAIVKLGIPQNTILVQTLLRVTQERINECDEICLSVLSTVLEAMEPCKNVHVLRTGFRILVDQQVWKIEDVFTLQVVMKCIGKDAPIALKRKLEMKALRELDRFSVLNSQHMFEVLAAMNHRSLILLDECSKVVLDNIHGCPLRIMINILQSCKDLQYHNLDLFKGLADYVAATFDIWKFRKVLFILILFENLGFRPVGLMDLFMKRIVEDPESLNMKNILSILHTYSSLNHVYKCQNKEQFVEVMASALTGYLHTISSENLLDAVYSFCLMNYFPLAPFNQLLQKDIISELLTSDDMKNAYKLHTLDTCLKLDDTVYLRDIALSLPQLPRELPSSHTNAKVAEVLSSLLGGEGHFSKDVHLPHNYHIDFEIRMDTNRNQVLPLSDVDTTSATDIQRVAVLCVSRSAYCLGSSHPRGFLAMKMRHLNAMGFHVILVNNWEMDKLEMEDAVTFLKTKIYSVEALPVAAVNVQSTQ

SEQ ID NO: 30812 - protein, 710 aa, Homo sapiens; identical to SEQ ID NO: 30811
  Payload ID: 6040
  Gene Symbol: FASTKD2
  Gene Name: FAST kinase domains 2
  Uniprot ID: Q9NYY8
  ENSP ID: ENSP00000384929

SEQ ID NO: 30813 - protein, 710 aa, Homo sapiens; identical to SEQ ID NO: 30811
  Payload ID: 6040
  Gene Symbol: FASTKD2
  Gene Name: FAST kinase domains 2
  Uniprot ID: Q9NYY8
  ENSP ID: ENSP00000385990

SEQ ID NO: 30814 - protein, 124 aa, Homo sapiens
  Payload ID: 6040
  Gene Symbol: FASTKD2
  Gene Name: FAST kinase domains 2
  ENSP ID: ENSP00000409927
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVD

SEQ ID NO: 30815 - protein, 662 aa, Homo sapiens
  Payload ID: 6041
  Gene Symbol: FASTKD3
  Gene Name: FAST kinase domains 3
  Uniprot ID: Q14CZ7
  ENSP ID: ENSP00000264669
MALITLRKNLYRLSDFQMHRALAALKNKPLNHVHKVVKERLCPWLCSRQPEPFGVKFHHAHCKKFHSKNGNDLHPLGGPVFSQVSDCDRLEQNVKNEESQMFYRRLSNLTSSEEVLSFISTMETLPDTMAAGALQRICEVEKKDGDQGLPKEILENSIFQALCFQFEKEPSQLSNTSLVTALQALILLHVDPQSSLLLNLVAECQNRLRKGGMEVRNLCILGESLITLHSSGCVTLELIINQLQGEKLETFTPEDIVALYRILQACTEKVDEHQTFLNKINNFSLSIVSNLSPKLISQMLTALVVLDQSQAFPLIIKLGKYVVRHVPHFTNEELRRVLEAFIYFGHHDTFFTKALEHRVAAVCLTLDPEVVCRVMEYCSRELILSKPILNAVAETFVCQTEKFSPRQISALMEPFGKLNYLPPNASALFRKLENVLFTHFNYFPPKSLLKLLHSCSLNECHPVNFLAKIFKPLFLQRLQGKESHLDTLSRAQLTQLFLASVLECPFYKGPKLLPKYQVKSFLTPCCSLETPVDSQLYRYVKIGLTNLLGARLYFAPKVLTPYCYTIDVEIKLDEEGFVLPSTANEDIHKRIALCIDGPKRFCSNSKHLLGKEAIKQRHLQLLGYQVVQIPYHEIGMLKSRRELVEYLQRKLFSQNTVHWLQE

SEQ ID NO: 30816 - protein, 608 aa, Homo sapiens
  Payload ID: 6041
  Gene Symbol: FASTKD3
  Gene Name: FAST kinase domains 3
  ENSP ID: ENSP00000421798
MALITLRKNLYRLSDFQMHRALAALKNKPLNHVHKVVKERLCPWLCSRQPEPFGVKFHHAHCKKFHSKNGNDLHPLGGPVFSQVSDCDRLEQNVKNEESQMFYRRLSNLTSSEEVLSFISTMETLPDTMAAGALQRICEVEKKDGDQGLPKEILENSIFQALCFQFEKEPSQLSNTSLVTALQALILLHVDPQSSLLLNLVAECQNRLRKGGMEVRNLCILGESLITLHSSGCVTLELIINQLQGEKLETFTPEDIVALYRILQACTEKVDEHQTFLNKINNFSLSIVSNLSPKLISQMLTALVVLDQSQAFPLIIKLGKYVVRHVPHFTNEELRRVLEAFIYFGHHDTFFTKALEHRVAAVCLTLDPEVVCRVMEYCSRELILSKPILNAVAETFVCQTEKFSPRQISALMEPFGKLNYLPPNASALFRKLENVLFTHFNYFPPKSLLKLLHSCSLNECHPVNFLAKIFKPLFLQRLQGKESHLDTLSRAQLTQLFLASVLECPFYKGPKLLPKYQVKSFLTPCCSLETPVDSQLYRYVKIGLTNLLGARLYFAPKVLTPYCYTIAFSPIDQCKVEGIKAKQRNEYRKIVFVRVSHEEFFLSSLTRC

SEQ ID NO: 30817 - protein, 181 aa, Homo sapiens
  Payload ID: 6041
  Gene Symbol: FASTKD3
  Gene Name: FAST kinase domains 3
  ENSP ID: ENSP00000422443
MHRALAALKNKPLNHVHKVVKERLCPWLCSRQPEPFGVKFHHAHCKKFHSKNGNDLHPLGGPVFSQVSDCDRLEQNVKNEESQMFYRRLSNLTSSEEVLSFISTMETLPDTMAAGALQRICEVEKKDGDQGLPKEILENSIFQALCFQFEKEPSQLSNTSLVTALQALILLHVDPQSSLLL

SEQ ID NO: 30818 - protein, 57 aa, Homo sapiens
  Payload ID: 6041
  Gene Symbol: FASTKD3
  Gene Name: FAST kinase domains 3
  ENSP ID: ENSP00000424568
MALITLRKNLYRLSDFQMHRALAALKNKPLNHVHKVVKERLCPWLCDTRTHYKSTSR

SEQ ID NO: 30819 - protein, 244 aa, Homo sapiens
  Payload ID: 6041
  Gene Symbol: FASTKD3
  Gene Name: FAST kinase domains 3
  ENSP ID: ENSP00000426008
MALITLRKNLYRLSDFQMHRALAALKNKPLNHVHKVVKERLCPWLCSRQPEPFGVKFHHAHCKKFHSKNGNDLHPLGGPVFSQVSDCDRLEQNVKNEESQMFYRRLSNLTSSEEVLSFISTMETLPDTMAAGALQRICEVEKKDGDQGLPKEILENSIFQALCFQFEKEPSQLSNTSLVTALQALILLHVDPQSSLLLNLVAECQNRLRKGGMEVRNLCILGESLITLHSSGCVTLELIINQLQ

SEQ ID NO: 30820 - protein, 764 aa, Homo sapiens
  Payload ID: 6042
  Gene Symbol: FASTKD5
  Gene Name: FAST kinase domains 5
  Uniprot ID: Q7L8L6
  ENSP ID: ENSP00000369618
MAATLKSLKLVRYRAFCSPSAFGAVRSVSYWNVSSTQHGGQDPPEHISLCHSAKKVKNICSTFSSRRILTTSSAHPGLEFSKTSSSKASTLQLGSPRATGVDEEDVEVFDSFENMRVFLQLRPEYRVHSYNASETSQLLSVSEGELILHKVRVNQNNLQAQVIVDYLCKLSSLPAEQHPVLLGSTSFALLCQLSVKKIQLFDTQDLINVLKAFVILGIPHSHSMLDVYETKCCHQVWEMNMDQLLLVADLWRYLGRKVPRFLNIFSSYLNLHWKDLSLSQLVHLIYVIGENRQVSQDLMQKLESLILKYIDLINLEEVGTICLGFFKSSTNLSEFVMRKIGDLACANIQHLSSRSLVNIVKMFRFTHVDHINFMKQIGEIAPQRIPSLGVQGVMHLTLYCSALRFLNEGVMNAVAASLPPRVAHCRSKDVAKILWSFGTLNYKPPNAEEFYSSLISEIHRKMPEFNQYPEHLPTCLLGLAFLEYFPVELIDFALSPGFVRLAQERTKFDLLKELYTLDGTVGIECPDYRGNRLSTHLQQEGSELLWYLAEKDMNSKPEFLETVFLLETMLGGPQYVKHHMILPHTRSSDLEVQLDVNLKPLPFNREATPAENVAKLRLEHVGVSLTDDLMNKLLKGKARGHFQGKTESEPGQQPMELENKAAVPLGGFLCNVADKSGAMEMAGLCPAACMQTPRMKLAVQFTNRNQYCYGSRDLLGLHNMKRRQLARLGYRVVELSYWEWLPLLKRTRLEKLAFLHEKVFTSAL

SEQ ID NO: 30821 - protein, 4588 aa, Homo sapiens
  Payload ID: 6043
  Gene Symbol: FAT1
  Gene Name: FAT atypical cadherin 1
  Uniprot ID: Q14517
  ENSP ID: ENSP00000406229
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 30822 - protein, 119 aa, Homo sapiens
  Payload ID: 6043
  Gene Symbol: FAT1
  Gene Name: FAT atypical cadherin 1
  ENSP ID: ENSP00000420869
LSKKPLEEKPSQPYSARESLSEVQSLSSFQSESCDDNASIVTVMHLVNAVVDTVSTEESLAAPDLSKPRGYHWDTSDWMPSVPLPDIQEFPNYEVIDEQTPLYSADPNAIDTDYYPGGY

SEQ ID NO: 30823 - protein, 52 aa, Homo sapiens
  Payload ID: 6043
  Gene Symbol: FAT1
  Gene Name: FAT atypical cadherin 1
  ENSP ID: ENSP00000421003
MTMAVIVRNKEKKVIFEFSGQISGSSFRSHFPPLPYSILFVVHTFLSHLELS

SEQ ID NO: 30824 - protein, 488 aa, Homo sapiens
  Payload ID: 6043
  Gene Symbol: FAT1
  Gene Name: FAT atypical cadherin 1
  ENSP ID: ENSP00000423736
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAV

SEQ ID NO: 30825 - protein, 285 aa, Homo sapiens
  Payload ID: 6043
  Gene Symbol: FAT1
  Gene Name: FAT atypical cadherin 1
  ENSP ID: ENSP00000423801
  MOD_RES (1)..(1): Any amino acid
XSTTEALFASVEDYILVRGVSLVHTAKMNPVRMAEHALTVWMAPFVSVIRVLGEKGVRVISTSALETLACTGPSVRTRTAPITATAATSTGDVTARMLRPTTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHA

SEQ ID NO: 30826 - protein, 368 aa, Homo sapiens
  Payload ID: 6043
  Gene Symbol: FAT1
  Gene Name: FAT atypical cadherin 1
  ENSP ID: ENSP00000424157
  MOD_RES (1)..(1): Any amino acid
XDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNESLAAPDLSKPRGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 30827 - protein, 4590 aa, Homo sapiens
  Payload ID: 6043
  Gene Symbol: FAT1
  Gene Name: FAT atypical cadherin 1
  ENSP ID: ENSP00000479573
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVPAHLTVMVRDQDVPVKRNFARIVVNVSDTNDHAPWFTASSYKGRVYESAAVGSVVLQVTALDKDKGKNAEVLYSIESGTFGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 30828 - protein, 4349 aa, Homo sapiens
  Payload ID: 6044
  Gene Symbol: FAT2
  Gene Name: FAT atypical cadherin 2
  Uniprot ID: Q9NYQ8
  ENSP ID: ENSP00000261800
MTIALLGFAIFLLHCATCEKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQYVLKPSSENVGFKLNARTGLITTTKLMDFHDRAHYQLHIRTSPGQASTVVVIDIVDCNNHAPLFNRSSYDGTLDENIPPGTSVLAVTATDRDHGENGYVTYSIAGPKALPFSIDPYLGIISTSKPMDYELMKRIYTFRVRASDWGSPFRREKEVSIFLQLRNLNDNQPMFEEVNCTGSIRQDWPVGKSIMTMSAIDVDELQNLKYEIVSGNELEYFDLNHFSGVISLKRPFINLTAGQPTSYSLKITASDGKNYASPTTLNITVVKDPHFEVPVTCDKTGVLTQFTKTILHFIGLQNQESSDEEFTSLSTYQINHYTPQFEDHFPQSIDVLESVPINTPLARLAATDPDAGFNGKLVYVIADGNEEGCFDIELETGLLTVAAPLDYEATNFYILNVTVYDLGTPQKSSWKLLTVNVKDWNDNAPRFPPGGYQLTISEDTEVGTTIAELTTKDADSEDNGRVRYTLLSPTEKFSLHPLTGELVVTGHLDRESEPRYILKVEARDQPSKGHQLFSVTDLIITLEDVNDNSPQCITEHNRLKVPEDLPPGTVLTFLDASDPDLGPAGEVRYVLMDGAHGTFRVDLMTGALILERELDFERRAGYNLSLWASDGGRPLARRTLCHVEVIVLDVNENLHPPHFASFVHQGQVQENSPSGTQVIVVAAQDDDSGLDGELQYFLRAGTGLAAFSINQDTGMIQTLAPLDREFASYYWLTVLAVDRGSVPLSSVTEVYIEVTDANDNPPQMSQAVFYPSIQEDAPVGTSVLQLDAWDPDSSSKGKLTFNITSGNYMGFFMIHPVTGLLSTAQQLDRENKDEHILEVTVLDNGEPSLKSTSRVVVGILDVNDNPPIFSHKLFNVRLPERLSPVSPGPVYRLVASDLDEGLNGRVTYSIEDSDEEAFSIDLVTGVVSSSSTFTAGEYNILTIKATDSGQPPLSASVRLHIEWIPWPRPSSIPLAFDETYYSFTVMETDPVNHMVGVISVEGRPGLFWFNISGGDKDMDFDIEKTTGSIVIARPLDTRRRSNYNLTVEVTDGSRTIATQVHIFMIANINHHRPQFLETRYEVRVPQDTVPGVELLRVQAIDQDKGKSLIYTIHGSQDPGSASLFQLDPSSGVLVTVGKLDLGSGPSQHTLTVMVRDQEIPIKRNFVWVTIHVEDGNLHPPRFTQLHYEASVPDTIAPGTELLQVRAMDADRGVNAEVHYSLLKGNSEGFFNINALLGIITLAQKLDQANHAPHTLTVKAEDQGSPQWHDLATVIIHVYPSDRSAPIFSKSEYFVEIPESIPVGSPILLVSAMSPSEVTYELREGNKDGVFSMNSYSGLISTQKKLDHEKISSYQLKIRGSNMAGAFTDVMVVVDIIDENDNAPMFLKSTFVGQISEAAPLYSMIMDKNNNPFVIHASDSDKEANSLLVYKILEPEALKFFKIDPSMGTLTIVSEMDYESMPSFQFCVYVHDQGSPVLFAPRPAQVIIHVRDVNDSPPRFSEQIYEVAIVGPIHPGMELLMVRASDEDSEVNYSIKTGNADEAVTIHPVTGSISVLNPAFLGLSRKLTIRASDGLYQDTALVKISLTQVLDKSLQFDQDVYWAAVKENLQDRKALVILGAQGNHLNDTLSYFLLNGTDMFHMVQSAGVLQTRGVAFDREQQDTHELAVEVRDNRTPQRVAQGLVRVSIEDVNDNPPKFKHLPYYTIIQDGTEPGDVLFQVSATDEDLGTNGAVTYEFAEDYTYFRIDPYLGDISLKKPFDYQALNKYHLKVIARDGGTPSLQSEEEVLVTVRNKSNPLFQSPYYKVRVPENITLYTPILHTQARSPEGLRLIYNIVEEEPLMLFTTDFKTGVLTVTGPLDYESKTKHVFTVRATDTALGSFSEATVEVLVEDVNDNPPTFSQLVYTTSISEGLPAQTPVIQLLASDQDSGRNRDVSYQIVEDGSDVSKFFQINGSTGEMSTVQELDYEAQQHFHVKVRAMDKGDPPLTGETLVVVNVSDINDNPPEFRQPQYEANVSELATCGHLVLKVQAIDPDSRDTSRLEYLILSGNQDRHFFINSSSGIISMFNLCKKHLDSSYNLRVGASDGVFRATVPVYINTTNANKYSPEFQQHLYEAELAENAMVGTKVIDLLAIDKDSGPYGTIDYTIINKLASEKFSINPNGQIATLQKLDRENSTERVIAIKVMARDGGGRVAFCTVKIILTDENDNPPQFKASEYTVSIQSNVSKDSPVIQVLAYDADEGQNADVTYSVNPEDLVKDVIEINPVTGVVKVKDSLVGLENQTLDFFIKAQDGGPPHWNSLVPVRLQVVPKKVSLPKFSEPLYTFSAPEDLPEGSEIGIVKAVAAQDPVIYSLVRGTTPESNKDGVFSLDPDTGVIKVRKPMDHESTKLYQIDVMAHCLQNTDVVSLVSVNIQVGDVNDNRPVFEADPYKAVLTENMPVGTSVIQVTAIDKDTGRDGQVSYRLSADPGSNVHELFAIDSESGWITTLQELDCETCQTYHFHVVAYDHGQTIQLSSQALVQVSITDENDNAPRFASEEYRGSVVENSEPGELVATLKTLDADISEQNRQVTCYITEGDPLGQFGISQVGDEWRISSRKTLDREHTAKYLLRVTASDGKFQASVTVEIFVLDVNDNSPQCSQLLYTGKVHEDVFPGHFILKVSATDLDTDTNAQITYSLHGPGAHEFKLDPHTGELTTLTALDRERKDVFNLVAKATDGGGRSCQADITLHVEDVNDNAPRFFPSHCAVAVFDNTTVKTPVAVVFARDPDQGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSLTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 30829 - protein, 1122 aa, Homo sapiens
  Payload ID: 6044
  Gene Symbol: FAT2
  Gene Name: FAT atypical cadherin 2
  ENSP ID: ENSP00000429678
  MOD_RES (1)..(1): Any amino acid
XGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSLTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 30830 - protein, 4557 aa, Homo sapiens
  Payload ID: 6045
  Gene Symbol: FAT3
  Gene Name: FAT atypical cadherin 3
  Uniprot ID: Q8TDW7
  ENSP ID: ENSP00000387040
MDIIMGHCVGTRPPACCLILLLFKLLATVSQGLPGTGPLGFHFTHSIYNATVYENSAARTYVNSQSRMGITLIDLSWDIKYRIVSGDEEGFFKAEEVIIADFCFLRIRTKGGNSAILNREIQDNYLLIVKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGLITTTSRKLDREQQAEHFLEVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTIKAVDNGRPQKSSTARLHIEWIKKPPPSPIPLTFDEPFYNFTVMESDRVTEIVGVVSVQPANTPLWFDIVGGNFDSAFDAEKGVGTIVIAKPLDAEQRSIYNMSVEVTDGTNVAVTQVFIKVLDNNDNGPEFSQPNYDVTISEDVLPDTEILQIEATDRDEKHKLSYTVHSSIDSISMRKFRIDPSTGVLYTAERLDHEAQDKHILNIMVRDQEFPYRRNLARVIVNVEDANDHSPYFTNPLYEASVFESAALGSAVLQVTALDKDKGENAELIYTIEAGNTGNMFKIEPVLGIITICKEPDMTTMGQFVLSIKVTDQGSPPMSATAIVRISVTMSDNSHPKFIHKDYQAEVNENVDIGTSVILISAISQSTLIYEVKDGDINGIFTINPYSGVITTQKALDYERTSSYQLIIQATNMAGMASNATVNIQIVDENDNAPVFLFSQYSGSLSEAAPINSIVRSLDNSPLVIRATDADSNRNALLVYQIVESTAKKFFTVDSSTGAIRTIANLDHETIAHFHFHVHVRDSGSPQLTAESPVEVNIEVTDVNDNPPVFTQAVFETILLLPTYVGVEVLKVSATDPDSEVPPELTYSLMEGSLDHFLIDSNSGVLTIKNNNLSKDHYMLIVKVSDGKFYSTSMVTIMVKEAMDSGLHFTQSFYSTSISENNTNITKVAIVNAVGNRLNEPLKYSILNPGNKFKIKSTSGVIQTTGVPFDREEQELYELVVEASRELDHLRVARVVVRVNIEDINDNSPVFVGLPYYAAVQVDAEPGTLIYQVTAIDKDKGPNGEVTYVLQDDYGHFEINPNSGNVILKEAFNSDLSNIEYGVTILAKDGGKPSLSTSVELPITIVNKAMPVFDKPFYTASVNEDIRMNTPILSINATSPEGQGIIYIIIDGDPFKQFNIDFDTGVLKVVSPLDYEVTSAYKLTIRASDALTGARAEVTVDLLVNDVNDNPPIFDQPTYNTTLSEASLIGTPVLQVVSIDADSENNKMVHYQIVQDTYNSTDYFHIDSSSGLILTARMLDHELVQHCTLKVRSIDSGFPSLSSEVLVHIYISDVNDNPPVFNQLIYESYVSELAPRGHFVTCVQASDADSSDFDRLEYSILSGNDRTSFLMDSKSGVITLSNHRKQRMEPLYSLNVSVSDGLFTSTAQVHIRVLGANLYSPAFSQSTYVAEVRENVAAGTKVIHVRATDGDPGTYGQISYAIINDFAKDRFLIDSNGQVITTERLDRENPLEGDVSIFVRALDGGGRTTFCTVRVIVVDENDNAPQFMTVEYRASVRADVGRGHLVTQVQAIDPDDGANSRITYSLYSEASVSVADLLEIDPDNGWMVTKGNFNQLKNTVLSFFVKAVDGGIPVKHSLIPVYIHVLPPETFLPSFTQSQYSFTIAEDTAIGSTVDTLRILPSQNVWFSTVNGERPENNKGGIFVIEQETGTIKLDKRLDRETSPAFHFKVAATIPLDKVDIVFTVDVDIKVLDLNDNKPVFETSSYDTIIMEGMPVGTKLTQVRAIDMDWGANGQVTYSLHSDSQPEKVMEAFNIDSNTGWISTLKDLDHETDPTFTFSVVASDLGEAFSLSSTALVSVRVTDINDNAPVFAQEVYRGNVKESDPPGEVVAVLSTWDRDTSDVNRQVSYHITGGNPRGRFALGLVQSEWKVYVKRPLDREEQDIYFLNITATDGLFVTQAMVEVSVSDVNDNSPVCDQVAYTALLPEDIPSNKIILKVSAKDADIGSNGYIRYSLYGSGNSEFFLDPESGELKTLALLDRERIPVYSLMAKATDGGGRFCQSNIHLILEDVNDNPPVFSSDHYNTCVYENTATKALLTRVQAVDPDIGINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERVSGYSLLVQAVDSGIPAMSSTATVNIDISDVNDNSPVFTPANYTAVIQENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEELIGIAVVLFVIFILVVLFIVFRKKVFRKNYSRNNITLVQDPATAALLNKSNGIPFRNLRGSGDGRNVYQEVGPPQVPVRPMAYTPCFQSDSRSNLDKIVDGLGGEHQEMTTFHPESPRILTARRGVVVCSVAPNLPAVSPCRSDCDSIRKNGWDAGTENKGVDDPGEVTCFAGSNKGSNSEVQSLSSFQSDSGDDNAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 30831 - protein, 4439 aa, Homo sapiens
  Payload ID: 6045
  Gene Symbol: FAT3
  Gene Name: FAT atypical cadherin 3
  ENSP ID: ENSP00000432586
MNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGLITTTSRKLDREQQAEHFLEVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTIKAVDNGRPQKSSTARLHIEWIKKPPPSPIPLTFDEPFYNFTVMESDRVTEIVGVVSVQPANTPLWFDIVGGNFDSAFDAEKGVGTIVIAKPLDAEQRSIYNMSVEVTDGTNVAVTQVFIKVLDNNDNGPEFSQPNYDVTISEDVLPDTEILQIEATDRDEKHKLSYTVHSSIDSISMRKFRIDPSTGVLYTAERLDHEAQDKHILNIMVRDQEFPYRRNLARVIVNVEDANDHSPYFTNPLYEASVFESAALGSAVLQVTALDKDKGENAELIYTIEAGNTGNMFKIEPVLGIITICKEPDMTTMGQFVLSIKVTDQGSPPMSATAIVRISVTMSDNSHPKFIHKDYQAEVNENVDIGTSVILISAISQSTLIYEVKDGDINGIFTINPYSGVITTQKALDYERTSSYQLIIQATNMAGMASNATVNIQIVDENDNAPVFLFSQYSGSLSEAAPINSIVRSLDNSPLVIRATDADSNRNALLVYQIVESTAKKFFTVDSSTGAIRTIANLDHETIAHFHFHVHVRDSGSPQLTAESPVEVNIEVTDVNDNPPVFTQAVFETILLLPTYVGVEVLKVSATDPDSEVPPELTYSLMEGSLDHFLIDSNSGVLTIKNNNLSKDHYMLIVKVSDGKFYSTSMVTIMVKEAMDSGLHFTQSFYSTSISENNTNITKVAIVNAVGNRLNEPLKYSILNPGNKFKIKSTSGVIQTTGVPFDREEQELYELVVEASRELDHLRVARVVVRVNIEDINDNSPVFVGLPYYAAVQVDAEPGTLIYQVTAIDKDKGPNGEVTYVLQDDYGHFEINPNSGNVILKEAFNSDLSNIEYGVTILAKDGGKPSLSTSVELPITIVNKAMPVFDKPFYTASVNEDIRMNTPILSINATSPEGQGIIYIIIDGDPFKQFNIDFDTGVLKVVSPLDYEVTSAYKLTIRASDALTGARAEVTVDLLVNDVNDNPPIFDQPTYNTTLSEASLIGTPVLQVVSIDADSENNKMVHYQIVQDTYNSTDYFHIDSSSGLILTARMLDHELVQHCTLKVRSIDSGFPSLSSEVLVHIYISDVNDNPPVFNQLIYESYVSELAPRGHFVTCVQASDADSSDFDRLEYSILSGNDRTSFLMDSKSGVITLSNHRKQRMEPLYSLNVSVSDGLFTSTAQVHIRVLGANLYSPAFSQSTYVAEVRENVAAGTKVIHVRATDGDPGTYGQISYAIINDFAKDRFLIDSNGQVITTERLDRENPLEGDVSIFVRALDGGGRTTFCTVRVIVVDENDNAPQFMTVEYRASVRADVGRGHLVTQVQAIDPDDGANSRITYSLYSEASVSVADLLEIDPDNGWMVTKGNFNQLKNTVLSFFVKAVDGGIPVKHSLIPVYIHVLPPETFLPSFTQSQYSFTIAEDTAIGSTVDTLRILPSQNVWFSTVNGERPENNKGGIFVIEQETGTIKLDKRLDRETSPAFHFKVAATIPLDKVDIVFTVDVDIKVLDLNDNKPVFETSSYDTIIMEGMPVGTKLTQVRAIDMDWGANGQVTYSLHSDSQPEKVMEAFNIDSNTGWISTLKDLDHETDPTFTFSVVASDLGEAFSLSSTALVSVRVTDINDNAPVFAQEVYRGNVKESDPPGEVVAVLSTWDRDTSDVNRQVSYHITGGNPRGRFALGLVQSEWKVYVKRPLDREEQDIYFLNITATDGLFVTQAMVEVSVSDVNDNSPVCDQVAYTALLPEDIPSNKIILKVSAKDADIGSNGYIRYSLYGSGNSEFFLDPESGELKTLALLDRERIPVYSLMAKATDGGGRFCQSNIHLILEDVNDNPPVFSSDHYNTCVYENTATKALLTRVQAVDPDIGINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERVSGYSLLVQAVDSGIPAMSSTATVNIDISDVNDNSPVFTPANYTAVIQENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEELIGIAVVLFVIFILVVLFIVFRKKVFRKNYSRNNITLVQDPATAALLNKSNGIPFRNLRGSGDGRNVYQEVGPPQVPVRPMAYTPCFQSDSRSNLDKIVDGLGGEHQEMTTFHPESPRILTARRGVVVCSVAPNLPAVSPCRSDCDSIRKNGWDAGTENKGVDDPGEVTCFAGSNKGSNSEVQSLSSFQSDSGDDNASIVTVIQLVNNVVDTIENEVSVMDQGQNYNRAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 30832 - protein, 892 aa, Homo sapiens
  Payload ID: 6045
  Gene Symbol: FAT3
  Gene Name: FAT atypical cadherin 3
  ENSP ID: ENSP00000436399
MHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEELIGIAVVLFVIFILVVLFIVFRKKVFRKNYSRNNITLVQDPATAALLNKSNGIPFRNLRGSGDGRNVYQEVGPPQVPVRPMAYTPCFQSDSRSNLDKIVDGLGGEHQEMTTFHPESPRILTARRGVVVCSVAPNLPAVSPCRSDCDSIRKNGWDAGTENKGVDDPGEVTCFAGSNKGSNSEVQSLSSFQSDSGDDNAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 30833 - protein, 3222 aa, Homo sapiens
  Payload ID: 6046
  Gene Symbol: FAT4
  Gene Name: FAT atypical cadherin 4
  Uniprot ID: Q6V0I7
  ENSP ID: ENSP00000335169
MVTTVVAVGDTLAQPLAAAEVFIVEITLQDINDNPPVFPTDMLDLTVEENIGDGSKIMQLTAMDADEGANALVTYTIISGADDSFRIDPESGDLIATRRLDRERRSKYSLLVRADDGLQSSDMRINITVSDVNDHTPKFSRPVYSFDIPEDTIPGSLVAAILATDDDSGVNGEITYIVNEDDEDGIFFLNPITGVFNLTRLLDYEVQQYYILTVRAEDGGGQFTTIRVYFNILDVNDNPPIFSLNSYSTSLMENLPVGSTVLVFNVTDADDGINSQLTYSIASGDSLGQFTVDKNGVLKVLKALDRESQSFYNLVVQVHDLPQIPASRFTSTAQVSIILLDVNDNPPTFLSPKLTYIPENTPIDTVVFKAQATDPDSGPNSYIEYTLLNPLGNKFSIGTIDGEVRLTGELDREEVSNYTLTVVATDKGQPSLSSSTEVVVMVLDINDNNPIFAQALYKVEINENTLTGTDIIQVFAADGDEGTNGQVRYGIVNGNTNQEFRIDSVTGAITVAKPLDREKTPTYHLTVQATDRGSTPRTDTSTVSIVLLDINDFVPVFELSPYSVNVPENLGTLPRTILQVVARDDDRGSNSKLSYVLFGGNEDNAFTLSASGELGVTQSLDRETKERFVLMITATDSGSPALTGTGTINVIVDDVNDNVPTFASKAYFTTIPEDAPTGTDVLLVNASDADASKNAVIRIIGGNSQFTINPSTGQIITSALLDRETKDNYTLVVVCSDAGSPEPLSSSTSVLVTVTDVNDNPPRFQHHPYVTHIPSPTLPGSFVFAVTVTDADIGPNSELHYSLSGRNSEKFHIDPLRGAIMAAGPLNGASEVTFSVHVKDGGSFPKTDSTTVTVRFVNKADFPKVRAKEQTFMFPENQPVSSLVTTITGSSLRGEPMSYYIASGNLGNTFQIDQLTGQVSISQPLDFEKIQKYVVWIEARDGGFPPFSSYEKLDITVLDVNDNAPIFKEDPFISEILENLSPRKILTVSAMDKDSGPNGQLDYEIVNGNMENSFSINHATGEIRSVRPLDREKVSHYVLTIKSSDKGSPSQSTSVKVMINILDENDNAPRFSQIFSAHVPENSPLGYTVTRVTTSDEDIGINAISRYSIMDASLPFTINPSTGDIVISRPLNREDTDRYRIRVSAHDSGWTVSTDVTIFVTDINDNAPRFSRTSYYLDCPELTEIGSKVTQVFATDPDEGSNGQVFYFIKSQSEYFRINATTGEIFNKQILKYQNVTGFSNVNINRHSFIVTSSDRGKPSLISETTVTINIVDSNDNAPQFLKSKYFTPVTKNVKVGTKLIRVTAIDDKDFGLNSEVEYFISNDNHLGKFKLDNDTGWISVASSLISDLNQNFFITVTAKDKGNPPLSSQATVHITVTEENYHTPEFSQSHMSATIPESHSIGSIVRTVSARDRDAAMNGLIKYSISSGNEEGIFAINSSTGILTLAKALDYELCQKHEMTISAIDGGWVARTGYCSVTVNVIDVNDNSPVFLSDDYFPTVLENAPSGTTVIHLNATDADSGTNAVIAYTVQSSDSDLFVIDPNTGVITTQGFLDFETKQSYHLTVKAFNVPDEERCSFATVNIQLKGTNEYVPRFVSKLYYFEISEAAPKGTIVGEVFASDRDLGTDGEVHYLIFGNSRKKGFQINKKTGQIYVSGILDREKEERVSLKVLAKNFGSIRGADIDEVTVNVTVLDANDPPIFTLNIYSVQISEGVPIGTHVTFVSAFDSDSIPSWSRFSYFIGSGNENGAFSINPQTGQITVTAELDRETLPIYNLSVLAVDSGTPSATGSASLLVTLEDINDNGPMLTVSEGEVMENKRPGTLVMTLQSTDPDLPPNQGPFTYYLLSTGPATSYFSLSTAGVLSTTREIDREQIADFYLSVVTKDSGVPQMSSTGTVHITVIDQNDNPSQSRTVEIFVNYYGNLFPGGILGSVKPQDPDVLDSFHCSLTSGVTSLFSIPGGTCDLNSQPRSTDGTFDLTVLSNDGVHSTVTSNIRVFFAGFSNATVDNSILLRLGVPTVKDFLTNHYLHFLRIASSQLTGLGTAVQLYSAYEENNRTFLLAAVKRNHNQYVNPSGVATFFESIKEILLRQSGVKVESVDHDSCVHGPCQNGGSCLRRLAVSSVLKSRESLPVIIVANEPLQPFLCKCLPGYAGSWCEIDIDECLPSPCHSGGTCHNLVGGFSCSCPDGFTGRACERDINECLQSPCKNGAICQNFPGSFNCVCKTGYTGVFGKHCELNSYGFEELSYMEFPSLDPNNNYIYVKFATIKSHALLLYNYDNQTGDRAEFLALEIAEERLRFSYNLGSGTYKLTTMKKVSDGHFHTVIARRAGMAASLTVDSCSENQEPGYCTVSNVAVSDDWTLDVQPNRVTVGGIRSLEPILQRRGHVESHDFVGCIMEFAVNGRPLEPSQALAAQGILDQYGDFISYCFKEKKCKKVCFTVTPDTALSLEGKGRLDYHMSQNEKREYLLRQSLRGAMLEPFGVNSLEVKFRTRSENGVLIHIQESSNYTTVKIKNGKVYFTSDAGIAGKVERNIPEVYVADGHWHTFLIGKNGTATVLSVDRIYNRDIIHPTQDFGGLDVLTISLGGIPPNQAHRDAQTAGFDGCIASMWYGGESLPFSGKHSLASISKTDPSVKIGCRGPNICASNPCWGDLLCINQWYAYRCVPPGDCASHPCQNGGSCEPGLHSGFTCSCPDSHTGRTCEMVVACLGVLCPQGKVCKAGSPAGHVCVLSQGPEEISLPLWAVPAIVGSCATVLALLVLSLILCNQCRGKKAKNPKEEKKPKEKKKKGSENVAFDDPDNIPPYGDDMTVRKQPEGNPKPDIIERENPYLIYDETDIPHNSETIPSAPLASPEQEIEHYDIDNASSIAPSDADIIQHYKQFRSHTPKFSIQRHSPLGFARQSPMPLGASSLTYQPSYGQGLRTSSLSHSACPTPNPLSRHSPAPFSKSSTFYRNSPARELHLPIRDGNTLEMHGDTCQPGIFNYATRLGRRSKSPQAMASHGSRPGSRLKQPIGQIPLESSPPVGLSIEEVERLNTPRPRNPSICSADHGRSSSEEDCRRPLSRTRNPADGIPAPESSSDSDSHESFTCSEMEYDREKPMVYTSRMPKLSQVNESDADDEDNYGARLKPRRYHGRRAEGGPVGTQAAAPGTADNTLPMKLGQQAGTFNWDNLLNWGPGFGHYVDVFKDLASLPEKAAANEEGKAGTTKPVPKDGEAEQYV

SEQ ID NO: 30834 - protein, 4981 aa, Homo sapiens
  Payload ID: 6046
  Gene Symbol: FAT4
  Gene Name: FAT atypical cadherin 4
  Uniprot ID: Q6V0I7
  ENSP ID: ENSP00000377862
MDLAPDRATGRPWLPLHTLSVSQLLRVFWLLSLLPGQAWVHGAEPRQVFQVLEEQPPGTLVGTIQTRPGFTYRLSESHALFAINSSTGALYTTSTIDRESLPSDVINLVVLSSAPTYPTEVRVLVRDLNDNAPVFPDPSIVVTFKEDSSSGRQVILDTATDSDIGSNGVDHRSYRIIRGNEAGRFRLDITLNPSGEGAFLHLVSKGGLDREVTPQYQLLVEVEDKGEPKRRGYLQVNVTVQDINDNPPVFGSSHYQAGVPEDAVVGSSVLQVAAADADEGTNADIRYRLQDEGTPFQMDPETGLITVREPLDFEARRQYSLTVQAMDRGVPSLTGRAEALIQLLDVNDNDPVVKFRYFPATSRYASVDENAQVGTVVALLTVTDADSPAANGNISVQILGGNEQRHFEVQSSKVPNLSLIKVASALDRERIPSYNLTVSVSDNYGAPPGAAVQARSSVASLVIFVNDINDHPPVFSQQVYRVNLSEEAPPGSYVSGISATDGDSGLNANLRYSIVSGNGLGWFHISEHSGLVTTGSSGGLDRELASQIVLNISARDQGVHPKVSYAQLVVTLLDVNDEKPVFSQPEGYDVSVVENAPTGTELLMLRATDGDLGDNGTVRFSLQEAETDRRSFRLDPVSGRLSTISSLDREEQAFYSLLVLATDLGSPPQSSMARINVSLLDINDNSPVFYPVQYFAHIKENEPGGSYITTVSATDPDLGTNGTVKYSISAGDRSRFQVNAQSGVISTRMALDREEKTAYQLQIVATDGGNLQSPNQAIVTITVLDTQDNPPVFSQVAYSFVVFENVALGYHVGSVSASTMDLNSNISYLITTGDQKGMFAINQVTGQLTTANVIDREEQSFYQLKVVASGGTVTGDTMVNITVKDLNDNSPHFLQAIESVNVVENWQAGHSIFQAKAVDPDEGVNGMVLYSLKQNPKNLFAINEKNGTISLLGPLDVHAGSYQIEILASDMGVPQLSSSVILTVYVHDVNDNSPVFDQLSYEVTLSESEPVNSRFFKVQASDKDSGANGEIAYTIAEGNTGDAFGIFPDGQLYIKSELDRELQDRYVLMVVASDRAVEPLSATVNVTVILEDVNDNRPLFNSTNYTFYFEEEQRAGSFVGKVSAVDKDFGPNGEVRYSFEMVQPDFELHAISGEITNTHQFDRESLMRRRGTAVFSFTVIATDQGIPQPLKDQATVHVYMKDINDNAPKFLKDFYQATISESAANLTQVLRVSASDVDEGNNGLIHYSIIKGNEERQFAIDSTSGQVTLIGKLDYEATPAYSLVIQAVDSGTIPLNSTCTLNIDILDENDNTPSFPKSTLFVDVLENMRIGELVSSVTATDSDSGDNADLYYSITGTNNHGTFSISPNTGSIFLAKKLDFETQSLYKLNITAKDQGRPPRSSTMSVVIHVRDFNDNPPSFPPGDIFKSIVENIPIGTSVISVTAHDPDADINGQLSYTIIQQMPRGNHFTIDEVKGTIYTNAEIDREFANLFELTVKANDQAVPIETRRYALKNVTILVTDLNDNVPMFISQNALAADPSAVIGSVLTTIMAADPDEGANGEIEYEIINGDTDTFIVDRYSGDLRVASALVPSQLIYNLIVSATDLGPERRKSTTELTIILQGLDGPVFTQPKYITILKEGEPIGTNVISIEAASPRGSEAPVEYYIVSVRCEEKTVGRLFTIGRHTGIIQTAAILDREQGACLYLVDVYAIEKSTAFPRTQRAEVEITLQDINDNPPVFPTDMLDLTVEENIGDGSKIMQLTAMDADEGANALVTYTIISGADDSFRIDPESGDLIATRRLDRERRSKYSLLVRADDGLQSSDMRINITVSDVNDHTPKFSRPVYSFDIPEDTIPGSLVAAILATDDDSGVNGEITYIVNEDDEDGIFFLNPITGVFNLTRLLDYEVQQYYILTVRAEDGGGQFTTIRVYFNILDVNDNPPIFSLNSYSTSLMENLPVGSTVLVFNVTDADDGINSQLTYSIASGDSLGQFTVDKNGVLKVLKALDRESQSFYNLVVQVHDLPQIPASRFTSTAQVSIILLDVNDNPPTFLSPKLTYIPENTPIDTVVFKAQATDPDSGPNSYIEYTLLNPLGNKFSIGTIDGEVRLTGELDREEVSNYTLTVVATDKGQPSLSSSTEVVVMVLDINDNNPIFAQALYKVEINENTLTGTDIIQVFAADGDEGTNGQVRYGIVNGNTNQEFRIDSVTGAITVAKPLDREKTPTYHLTVQATDRGSTPRTDTSTVSIVLLDINDFVPVFELSPYSVNVPENLGTLPRTILQVVARDDDRGSNSKLSYVLFGGNEDNAFTLSASGELGVTQSLDRETKERFVLMITATDSGSPALTGTGTINVIVDDVNDNVPTFASKAYFTTIPEDAPTGTDVLLVNASDADASKNAVIRIIGGNSQFTINPSTGQIITSALLDRETKDNYTLVVVCSDAGSPEPLSSSTSVLVTVTDVNDNPPRFQHHPYVTHIPSPTLPGSFVFAVTVTDADIGPNSELHYSLSGRNSEKFHIDPLRGAIMAAGPLNGASEVTFSVHVKDGGSFPKTDSTTVTVRFVNKADFPKVRAKEQTFMFPENQPVSSLVTTITGSSLRGEPMSYYIASGNLGNTFQIDQLTGQVSISQPLDFEKIQKYVVWIEARDGGFPPFSSYEKLDITVLDVNDNAPIFKEDPFISEILENLSPRKILTVSAMDKDSGPNGQLDYEIVNGNMENSFSINHATGEIRSVRPLDREKVSHYVLTIKSSDKGSPSQSTSVKVMINILDENDNAPRFSQIFSAHVPENSPLGYTVTRVTTSDEDIGINAISRYSIMDASLPFTINPSTGDIVISRPLNREDTDRYRIRVSAHDSGWTVSTDVTIFVTDINDNAPRFSRTSYYLDCPELTEIGSKVTQVFATDPDEGSNGQVFYFIKSQSEYFRINATTGEIFNKQILKYQNVTGFSNVNINRHSFIVTSSDRGKPSLISETTVTINIVDSNDNAPQFLKSKYFTPVTKNVKVGTKLIRVTAIDDKDFGLNSEVEYFISNDNHLGKFKLDNDTGWISVASSLISDLNQNFFITVTAKDKGNPPLSSQATVHITVTEENYHTPEFSQSHMSATIPESHSIGSIVRTVSARDRDAAMNGLIKYSISSGNEEGIFAINSSTGILTLAKALDYELCQKHEMTISAIDGGWVARTGYCSVTVNVIDVNDNSPVFLSDDYFPTVLENAPSGTTVIHLNATDADSGTNAVIAYTVQSSDSDLFVIDPNTGVITTQGFLDFETKQSYHLTVKAFNVPDEERCSFATVNIQLKGTNEYVPRFVSKLYYFEISEAAPKGTIVGEVFASDRDLGTDGEVHYLIFGNSRKKGFQINKKTGQIYVSGILDREKEERVSLKVLAKNFGSIRGADIDEVTVNVTVLDANDPPIFTLNIYSVQISEGVPIGTHVTFVSAFDSDSIPSWSRFSYFIGSGNENGAFSINPQTGQITVTAELDRETLPIYNLSVLAVDSGTPSATGSASLLVTLEDINDNGPMLTVSEGEVMENKRPGTLVMTLQSTDPDLPPNQGPFTYYLLSTGPATSYFSLSTAGVLSTTREIDREQIADFYLSVVTKDSGVPQMSSTGTVHITVIDQNDNPSQSRTVEIFVNYYGNLFPGGILGSVKPQDPDVLDSFHCSLTSGVTSLFSIPGGTCDLNSQPRSTDGTFDLTVLSNDGVHSTVTSNIRVFFAGFSNATVDNSILLRLGVPTVKDFLTNHYLHFLRIASSQLTGLGTAVQLYSAYEENNRTFLLAAVKRNHNQYVNPSGVATFFESIKEILLRQSGVKVESVDHDSCVHGPCQNGGSCLRRLAVSSVLKSRESLPVIIVANEPLQPFLCKCLPGYAGSWCEIDIDECLPSPCHSGGTCHNLVGGFSCSCPDGFTGRACERDINECLQSPCKNGAICQNFPGSFNCVCKTGYTGKMCESSVNYCECNPCFNGGSCQSGVDSYYCHCPFGVFGKHCELNSYGFEELSYMEFPSLDPNNNYIYVKFATIKSHALLLYNYDNQTGDRAEFLALEIAEERLRFSYNLGSGTYKLTTMKKVSDGHFHTVIARRAGMAASLTVDSCSENQEPGYCTVSNVAVSDDWTLDVQPNRVTVGGIRSLEPILQRRGHVESHDFVGCIMEFAVNGRPLEPSQALAAQGILDQCPRLEGACTRSPCQHGGTCMDYWSWQQCHCKEGLTGKYCEKSVTPDTALSLEGKGRLDYHMSQNEKREYLLRQSLRGAMLEPFGVNSLEVKFRTRSENGVLIHIQESSNYTTVKIKNGKVYFTSDAGIAGKVERNIPEVYVADGHWHTFLIGKNGTATVLSVDRIYNRDIIHPTQDFGGLDVLTISLGGIPPNQAHRDAQTAGFDGCIASMWYGGESLPFSGKHSLASISKTDPSVKIGCRGPNICASNPCWGDLLCINQWYAYRCVPPGDCASHPCQNGGSCEPGLHSGFTCSCPDSHTGRTCEMVVACLGVLCPQGKVCKAGSPAGHVCVLSQGPEEISLPLWAVPAIVGSCATVLALLVLSLILCNQCRGKKAKNPKEEKKPKEKKKKGSENVAFDDPDNIPPYGDDMTVRKQPEGNPKPDIIERENPYLIYDETDIPHNSETIPSAPLASPEQEIEHYDIDNASSIAPSDADIIQHYKQFRSHTPKFSIQRHSPLGFARQSPMPLGASSLTYQPSYGQGLRTSSLSHSACPTPNPLSRHSPAPFSKSSTFYRNSPARELHLPIRDGNTLEMHGDTCQPGIFNYATRLGRRSKSPQAMASHGSRPGSRLKQPIGQIPLESSPPVGLSIEEVERLNTPRPRNPSICSADHGRSSSEEDCRRPLSRTRNPADGIPAPESSSDSDSHESFTCSEMEYDREKPMVYTSRMPKLSQVNESDADDEDNYGARLKPRRYHGRRAEGGPVGTQAAAPGTADNTLPMKLGQQAGTFNWDNLLNWGPGFGHYVDVFKDLASLPEKAAANEEGKAGTTKPVPKDGEAEQYV

SEQ ID NO: 30835 - protein, 129 aa, Homo sapiens
  Payload ID: 6047
  Gene Symbol: FTO
  Gene Name: fat mass and obesity associated
  ENSP ID: ENSP00000268349
EQRNEILTAILASLTARQNLRREWHARAERSVGASHELPEHYLLIRSQNVGHTGKRMMLRCLCRLTSQTSFQNSEVSFWKQNPRRSTSLRRRRKRDRLFSSNVVMGLSKSSGDFSWPLDCSTRVPIQNS

SEQ ID NO: 30836 - protein, 106 aa, Homo sapiens
  Payload ID: 6047
  Gene Symbol: FTO
  Gene Name: fat mass and obesity associated
  Uniprot ID: Q9C0B1
  ENSP ID: ENSP00000415636
MAQLEALWKKMEGVTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 30837 - protein, 106 aa, Homo sapiens; identical to SEQ ID NO: 30836
  Payload ID: 6047
  Gene Symbol: FTO
  Gene Name: fat mass and obesity associated
  Uniprot ID: Q9C0B1
  ENSP ID: ENSP00000417422

SEQ ID NO: 30838 - protein, 127 aa, Homo sapiens
  Payload ID: 6047
  Gene Symbol: FTO
  Gene Name: fat mass and obesity associated
  Uniprot ID: Q9C0B1
  ENSP ID: ENSP00000417843
MEWRKVSECNSVEPCREVKKWPYRCIHHGKNFSRMTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 30839 - protein, 70 aa, Homo sapiens
  Payload ID: 6047
  Gene Symbol: FTO
  Gene Name: fat mass and obesity associated
  ENSP ID: ENSP00000418424
MKRTPTAEEREREAKKLRLLEELEDTWLPYLTPKDDEFYQQALKRKVRMTLISKAGILIFGMLVLRSHGT

SEQ ID NO: 30840 - protein, 505 aa, Homo sapiens
  Payload ID: 6047
  Gene Symbol: FTO
  Gene Name: fat mass and obesity associated
  Uniprot ID: Q9C0B1
  ENSP ID: ENSP00000418823
MKRTPTAEEREREAKKLRLLEELEDTWLPYLTPKDDEFYQQWQLKYPKLILREASSVSEELHKEVQEAFLTLHKHGCLFRDLVRIQGKDLLTPVSRILIGNPGCTYKYLNTRLFTVPWPVKGSNIKHTEAEIAAACETFLKLNDYLQIETIQALEELAAKEKANEDAVPLCMSADFPRVGMGSSYNGQDEVDIKSRAAYNVTLLNFMDPQKMPYLKEEPYFGMGKMAVSWHHDENLVDRSAVAVYSYSCEGPEEESEDDSHLEGRDPDIWHVGFKISWDIETPGLAIPLHQGDCYFMLDDLNATHQHCVLAGSQPRFSSTHRVAECSTGTLDYILQRCQLALQNVCDDVDNDDVSLKSFEPAVLKQGEEIHNEVEFEWLRQFWFQGNRYRKCTDWWCQPMAQLEALWKKMEGVTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 30841 - protein, 292 aa, Homo sapiens
  Payload ID: 6048
  Gene Symbol: FITM1
  Gene Name: fat storage-inducing transmembrane protein 1
  Uniprot ID: A5D6W6
  ENSP ID: ENSP00000267426
MERGPVVGAGLGAGARIQALLGCLLKVLLWVASALLYFGSEQAARLLGSPCLRRLYHAWLAAVVIFGPLLQFHVNPRTIFASHGNFFNIKFVNSAWGWTCTFLGGFVLLVVFLATRRVAVTARHLSRLVVGAAVWRGAGRAFLLIEDLTGSCFEPLPQGLLLHELPDRRSCLAAGHQWRGYTVSSHTFLLTFCCLLMAEEAAVFAKYLAHGLPAGAPLRLVFLLNVLLLGLWNFLLLCTVIYFHQYTHKVVGAAVGTFAWYLTYGSWYHQPWSPGSPGHGLFPRPHSSRKHN

SEQ ID NO: 30842 - protein, 96 aa, Homo sapiens
  Payload ID: 6048
  Gene Symbol: FITM1
  Gene Name: fat storage-inducing transmembrane protein 1
  Uniprot ID: A5D6W6
  ENSP ID: ENSP00000453741
MAEEAAVFAKYLAHGLPAGAPLRLVFLLNVLLLGLWNFLLLCTVIYFHQYTHKVVGAAVGTFAWYLTYGSWYHQPWSPGSPGHGLFPRPHSSRKHN

SEQ ID NO: 30843 - protein, 262 aa, Homo sapiens
  Payload ID: 6049
  Gene Symbol: FITM2
  Gene Name: fat storage-inducing transmembrane protein 2
  Uniprot ID: Q8N6M3
  ENSP ID: ENSP00000380037
MEHLERCEWLLRGTLVRAAVRRYLPWALVASMLAGSLLKELSPLPESYLSNKRNVLNVYFVKVAWAWTFCLLLPFIALTNYHLTGKAGLVLRRLSTLLVGTAIWYICTSIFSNIEHYTGSCYQSPALEGVRKEHQSKQQCHQEGGFWHGFDISGHSFLLTFCALMIVEEMSVLHEVKTDRSHCLHTAITTLVVALGILTFIWVLMFLCTAVYFHNLSQKVFGTLFGLLSWYGTYGFWYPKAFSPGLPPQSCSLNLKQDSYKK

SEQ ID NO: 30844 - protein, 892 aa, Homo sapiens; identical to SEQ ID NO: 30832
  Payload ID: 6050
  Gene Symbol:
  Gene Name: FAT3
  ENSP ID: ENSP00000488913

SEQ ID NO: 30845 - protein, 4439 aa, Homo sapiens; identical to SEQ ID NO: 30831
  Payload ID: 6050
  Gene Symbol:
  Gene Name: FAT3
  ENSP ID: ENSP00000489343

SEQ ID NO: 30846 - protein, 4557 aa, Homo sapiens; identical to SEQ ID NO: 30830
  Payload ID: 6050
  Gene Symbol:
  Gene Name: FAT3
  ENSP ID: ENSP00000489369

SEQ ID NO: 30847 - protein, 372 aa, Homo sapiens
  Payload ID: 6051
  Gene Symbol: FA2H
  Gene Name: fatty acid 2-hydroxylase
  Uniprot ID: Q7L5A8
  ENSP ID: ENSP00000219368
MAPAPPPAASFSPSEVQRRLAAGACWVRRGARLYDLSSFVRHHPGGEQLLRARAGQDISADLDGPPHRHSANARRWLEQYYVGELRGEQQGSMENEPVALEETQKTDPAMEPRFKVVDWDKDLVDWRKPLLWQVGHLGEKYDEWVHQPVTRPIRLFHSDLIEGLSKTVWYSVPIIWVPLVLYLSWSYYRTFAQGNVRLFTSFTTEYTVAVPKSMFPGLFMLGTFLWSLIEYLIHRFLFHMKPPSDSYYLIMLHFVMHGQHHKAPFDGSRLVFPPVPASLVIGVFYLCMQLILPEAVGGTVFAGGLLGYVLYDMTHYYLHFGSPHKGSYLYSLKAHHVKHHFAHQKSGFGISTKLWDYCFHTLTPEKPHLKTQ

SEQ ID NO: 30848 - protein, 156 aa, Homo sapiens
  Payload ID: 6051
  Gene Symbol: FA2H
  Gene Name: fatty acid 2-hydroxylase
  ENSP ID: ENSP00000455126
MAPAPPPAASFSPSEVQRRLAAGACWVRRGARLYDLSSFVRHHPGGEQLLRARAGQDISADLDGPPHRHSANARRWLEQYYVGELRGEQQGSMENEPVALEETQKTDPAMEPRFKVVDWDKSTRWQCPSPCSPGSSCWGHSSGASSSTSSTASCST

SEQ ID NO: 30849 - protein, 192 aa, Homo sapiens
  Payload ID: 6051
  Gene Symbol: FA2H
  Gene Name: fatty acid 2-hydroxylase
  ENSP ID: ENSP00000464576
MPSFQLPAMATSTMASFSHKDTEKGSMENEPVALEETQKTDPAMEPRFKVVDWDKDLVDWRKPLLWQVGHLGEKYDEWVHQPVTRPIRLFHSDLIEGLSKTVWYSVPIIWVPLVLYLSWSYYRTFAQGNVRLFTSFTTEYTVAVPKSMFPGLFMLGTFLWSLIEYLIHRFLFHMKPPSDSYYLIMLHFVMHG

SEQ ID NO: 30850 - protein, 18 aa, Homo sapiens
  Payload ID: 6051
  Gene Symbol: FA2H
  Gene Name: fatty acid 2-hydroxylase
  ENSP ID: ENSP00000479548
  MOD_RES (1)..(1): Any amino acid
XLFTSFTTGNASFFPDLP

SEQ ID NO: 30851 - protein, 579 aa, Homo sapiens
  Payload ID: 6052
  Gene Symbol: FAAH
  Gene Name: fatty acid amide hydrolase
  Uniprot ID: O00519
  ENSP ID: ENSP00000243167
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLSKSGLKGCVYGQEAVRLSVGPMARDVESLALCLRALLCEDMFRLDPTVPPLPFREEVYTSSQPLRVGYYETDNYTMPSPAMRRAVLETKQSLEAAGHTLVPFLPSNIPHALETLSTGGLFSDGGHTFLQNFKGDFVDPCLGDLVSILKLPQWLKGLLAFLVKPLLPRLSAFLSNMKSRSAGKLWELQHEIEVYRKTVIAQWRALDLDVVLTPMLAPALDLNAPGRATGAVSYTMLYNCLDFPAGVVPVTTVTAEDEAQMEHYRGYFGDIWDKMLQKGMKKSVGLPVAVQCVALPWQEELCLRFMREVERLMTPEKQSS

SEQ ID NO: 30852 - protein, 49 aa, Homo sapiens
  Payload ID: 6052
  Gene Symbol: FAAH
  Gene Name: fatty acid amide hydrolase
  ENSP ID: ENSP00000481641
  MOD_RES (1)..(1): Any amino acid
XGGSIRFPSSFCGICGLKPTGNRLRSTPALSPCVWGTMRLTTIPCPPRP

SEQ ID NO: 30853 - protein, 532 aa, Homo sapiens
  Payload ID: 6053
  Gene Symbol: FAAH2
  Gene Name: fatty acid amide hydrolase 2
  Uniprot ID: Q6GMR7
  ENSP ID: ENSP00000364035
MAPSFTARIQLFLLRALGFLIGLVGRAALVLGGPKFASKTPRPVTEPLLLLSGMQLAKLIRQRKVKCIDVVQAYINRIKDVNPMINGIVKYRFEEAMKEAHAVDQKLAEKQEDEATLENKWPFLGVPLTVKEAFQLQGMPNSSGLMNRRDAIAKTDATVVALLKGAGAIPLGITNCSELCMWYESSNKIYGRSNNPYDLQHIVGGSSGGEGCTLAAACSVIGVGSDIGGSIRMPAFFNGIFGHKPSPGVVPNKGQFPLAVGAQELFLCTGPMCRYAEDLAPMLKVMAGPGIKRLKLDTKVHLKDLKFYWMEHDGGSFLMSKVDQDLIMTQKKVVVHLETILGASVQHVKLKKMKYSFQLWIAMMSAKGHDGKEPVKFVDLLGDHGKHVSPLWELIKWCLGLSVYTIPSIGLALLEEKLRYSNEKYQKFKAVEESLRKELVDMLGDDGVFLYPSHPTVAPKHHVPLTRPFNFAYTGVFSALGLPVTQCPLGLNAKGLPLGIQVVAGPFNDHLTLAVAQYLEKTFGGWVCPGKF

SEQ ID NO: 30854 - protein, 127 aa, Homo sapiens
  Payload ID: 6054
  Gene Symbol: FABP1
  Gene Name: fatty acid binding protein 1, liver
  Uniprot ID: P07148
  ENSP ID: ENSP00000295834
MSFSGKYQLQSQENFEAFMKAIGLPEELIQKGKDIKGVSEIVQNGKHFKFTITAGSKVIQNEFTVGEECELETMTGEKVKTVVQLEGDNKLVTTFKNIKSVTELNGDIITNTMTLGDIVFKRISKRI

SEQ ID NO: 30855 - protein, 124 aa, Homo sapiens
  Payload ID: 6054
  Gene Symbol: FABP1
  Gene Name: fatty acid binding protein 1, liver
  ENSP ID: ENSP00000377351
MSFSGKYQLQSQENFEAFMKAIGLPEELIQKGKDIKGVSEIVQNGKHFKFTITAGSKVIQNEFTVGEECELETMTGEKVKTVVQLEGDNKLVTTFKNIKSVTELNGDIITNVSWWCSERVAPSA

SEQ ID NO: 30856 - protein, 140 aa, Homo sapiens
  Payload ID: 6055
  Gene Symbol: FABP12
  Gene Name: fatty acid binding protein 12
  Uniprot ID: A6NFH5
  ENSP ID: ENSP00000353650
MIDQLQGTWKSISCENSEDYMKELGIGRASRKLGRLAKPTVTISTDGDVITIKTKSIFKNNEISFKLGEEFEEITPGGHKTKSKVTLDKESLIQVQDWDGKETTITRKLVDGKMVVESTVNSVICTRTYEKVSSNSVSNS

SEQ ID NO: 30857 - protein, 90 aa, Homo sapiens
  Payload ID: 6055
  Gene Symbol: FABP12
  Gene Name: fatty acid binding protein 12
  ENSP ID: ENSP00000427973
  MOD_RES (1)..(1): Any amino acid
XSEDYMKELGIGRASRKLGRLAKPTVTISTDGDVITIKTKSIFKNNEISFKLGEEFEEITPGGHKTKVRPTTVFQTHFKRMLVRYHPRVK

SEQ ID NO: 30858 - protein, 132 aa, Homo sapiens
  Payload ID: 6056
  Gene Symbol: FABP2
  Gene Name: fatty acid binding protein 2, intestinal
  Uniprot ID: P12104
  ENSP ID: ENSP00000274024
MAFDSTWKVDRSENYDKFMEKMGVNIVKRKLAAHDNLKLTITQEGNKFTVKESSTFRNIEVVFELGVTFNYNLADGTELRGTWSLEGNKLIGKFKRTDNGNELNTVREIIGDELVQTYVYEGVEAKRIFKKD

SEQ ID NO: 30859 - protein, 133 aa, Homo sapiens [sequence omitted]

SEQ ID NO: 30860 - protein, 132 aa, Homo sapiens
  Payload ID: 6057
  Gene Symbol: FABP3
  Gene Name: fatty acid binding protein 3, muscle and heart
  ENSP ID: ENSP00000473982
MVDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILTLTHGTAVCTRTYEKE

SEQ ID NO: 30861 - protein, 89 aa, Homo sapiens
  Payload ID: 6057
  Gene Symbol: FABP3
  Gene Name: fatty acid binding protein 3, muscle and heart
  ENSP ID: ENSP00000474078
MVDAFLGTWKLVDSKNFDDYMKSLGVGFATRQVASMTKPTTIIEKNGDILTLKTHSTFKNTEISFKLGVEFDETTADDRKVKHRARMFF

SEQ ID NO: 30862 - protein, 132 aa, Homo sapiens
  Payload ID: 6058
  Gene Symbol: FABP4
  Gene Name: fatty acid binding protein 4, adipocyte
  Uniprot ID: P15090
  ENSP ID: ENSP00000256104
MCDAFVGTWKLVSSENFDDYMKEVGVGFATRKVAGMAKPNMIISVNGDVITIKSESTFKNTEISFILGQEFDEVTADDRKVKSTITLDGGVLVHVQKWDGKSTTIKRKREDDKLVVECVMKGVTSTRVYERA

SEQ ID NO: 30863 - protein, 39 aa, Homo sapiens
  Payload ID: 6058
  Gene Symbol: FABP4
  Gene Name: fatty acid binding protein 4, adipocyte
  ENSP ID: ENSP00000428385
MCDAFVGTWKLVSSENFDDYMKEEWALPPGKWLAWPNLT

SEQ ID NO: 30864 - protein, 135 aa, Homo sapiens
  Payload ID: 6059
  Gene Symbol: FABP5
  Gene Name: fatty acid binding protein 5 (psoriasis-associated)
  Uniprot ID: Q01469
  ENSP ID: ENSP00000297258
MATVQQLEGRWRLVDSKGFDEYMKELGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 30865 - protein, 101 aa, Homo sapiens
  Payload ID: 6059
  Gene Symbol: FABP5
  Gene Name: fatty acid binding protein 5 (psoriasis-associated)
  ENSP ID: ENSP00000379647
MGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 30866 - protein, 177 aa, Homo sapiens
  Payload ID: 6060
  Gene Symbol: FABP6
  Gene Name: fatty acid binding protein 6, ileal
  Uniprot ID: P51161
  ENSP ID: ENSP00000377549
MKTVTMMMVVEMQALTQVLRAVLSACTWVSRKGDLQRMKQTHKGKPPSSMAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 30867 - protein, 128 aa, Homo sapiens
  Payload ID: 6060
  Gene Symbol: FABP6
  Gene Name: fatty acid binding protein 6, ileal
  Uniprot ID: P51161
  ENSP ID: ENSP00000385433
MAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 30868 - protein, 38 aa, Homo sapiens
  Payload ID: 6060
  Gene Symbol: FABP6
  Gene Name: fatty acid binding protein 6, ileal
  ENSP ID: ENSP00000428766
LTQVLRAVLSACTWVSRKGDLQRMKQTHKGKRTFSQDG

SEQ ID NO: 30869 - protein, 166 aa, Homo sapiens
  Payload ID: 6061
  Gene Symbol: FABP7
  Gene Name: fatty acid binding protein 7, brain
  Uniprot ID: O15540
  ENSP ID: ENSP00000348931
MVEAFCATWKLTNSQNFDEYMKALGVGFATRQVGNVTKPTVIISQEGDKVVIRTLSTFKNTEISFQLGEEFDETTADDRNCKSVVSLDGDKLVHIQKWDGKETNFVREIKDGKMVMVSNDNSPFFLVFFSSPHTSHLLPSSSLLLPFFLLPSFFNNTSLARFFNYM

SEQ ID NO: 30870 - protein, 132 aa, Homo sapiens
  Payload ID: 6061
  Gene Symbol: FABP7
  Gene Name: fatty acid binding protein 7, brain
  Uniprot ID: O15540
  ENSP ID: ENSP00000357429
MVEAFCATWKLTNSQNFDEYMKALGVGFATRQVGNVTKPTVIISQEGDKVVIRTLSTFKNTEISFQLGEEFDETTADDRNCKSVVSLDGDKLVHIQKWDGKETNFVREIKDGKMVMTLTFGDVVAVRHYEKA

SEQ ID NO: 30871 - protein, 132 aa, Homo sapiens
  Payload ID: 6062
  Gene Symbol: FABP9
  Gene Name: fatty acid binding protein 9, testis
  Uniprot ID: Q0Z7S8
  ENSP ID: ENSP00000368362
MVEPFLGTWKLVSSENFEDYMKELGVNFAARNMAGLVKPTVTISVDGKMMTIRTESSFQDTKISFKLGEEFDETTADNRKVKSTITLENGSMIHVQKWLGKETTIKRKIVDEKMVVECKMNNIVSTRIYEKV

SEQ ID NO: 30872 - protein, 501 aa, Homo sapiens
  Payload ID: 6063
  Gene Symbol: FADS1
  Gene Name: fatty acid desaturase 1
  ENSP ID: ENSP00000322229
MGTRAARPAGLPCGAENPARRRLALGARQQIHSWSPRTPSTRLTAPAGPARGVARPAMAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 30873 - protein, 47 aa, Homo sapiens
  Payload ID: 6063
  Gene Symbol: FADS1
  Gene Name: fatty acid desaturase 1
  ENSP ID: ENSP00000391229
MNSLLIGELSPEQPSFEPTKNKELTDEFRELRATVERMGLMKANHVF

SEQ ID NO: 30874 - protein, 360 aa, Homo sapiens
  Payload ID: 6063
  Gene Symbol: FADS1
  Gene Name: fatty acid desaturase 1
  Uniprot ID: O60427
  ENSP ID: ENSP00000405087
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 30875 - protein, 228 aa, Homo sapiens
  Payload ID: 6063
  Gene Symbol: FADS1
  Gene Name: fatty acid desaturase 1
  ENSP ID: ENSP00000407895
  MOD_RES (1)..(1): Any amino acid
XARPAMAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQHFGRPRWPDHLISVQDQPGQRGETSTKNTKRPGTVAHACNTSTLGGQDGQII

SEQ ID NO: 30876 - protein, 139 aa, Homo sapiens
  Payload ID: 6063
  Gene Symbol: FADS1
  Gene Name: fatty acid desaturase 1
  ENSP ID: ENSP00000416043
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKP

SEQ ID NO: 30877 - protein, 175 aa, Homo sapiens
  Payload ID: 6063
  Gene Symbol: FADS1
  Gene Name: fatty acid desaturase 1
  ENSP ID: ENSP00000429016
  MOD_RES (1)..(1): Any amino acid
XGVARPAMAPDPVAAETAAQGPTPRYFTWDEVAQRSGCEERWLVIDRKVYNISEFTRRHPGGSRVISHYAGQDATKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLK

SEQ ID NO: 30878 - protein, 86 aa, Homo sapiens
  Payload ID: 6063
  Gene Symbol: FADS1
  Gene Name: fatty acid desaturase 1
  ENSP ID: ENSP00000438997
MNSLLIGELSPEQPSFEPTKNKELTDEFRELRATVERMGLMKANHVFFLLYLLHILLLDGAAWLTLWVFGTSFLPFLLCAVLLSAV

SEQ ID NO: 30879 - protein, 192 aa, Homo sapiens
  Payload ID: 6063
  Gene Symbol: FADS1
  Gene Name: fatty acid desaturase 1
  ENSP ID: ENSP00000439097
MTFLCSCLLFVSVSSPVGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 30880 - protein, 109 aa, Homo sapiens
  Payload ID: 6063
  Gene Symbol: FADS1
  Gene Name: fatty acid desaturase 1
  ENSP ID: ENSP00000439790
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWN

SEQ ID NO: 30881 - protein, 153 aa, Homo sapiens
  Payload ID: 6063
  Gene Symbol: FADS1
  Gene Name: fatty acid desaturase 1
  ENSP ID: ENSP00000440652
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPF

SEQ ID NO: 30882 - protein, 360 aa, Homo sapiens; identical to SEQ ID NO: 30874
  Payload ID: 6063
  Gene Symbol: FADS1
  Gene Name: fatty acid desaturase 1
  Uniprot ID: O60427
  ENSP ID: ENSP00000441403

SEQ ID NO: 30883 - protein, 165 aa, Homo sapiens
  Payload ID: 6063
  Gene Symbol: FADS1
  Gene Name: fatty acid desaturase 1
  ENSP ID: ENSP00000441871
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVEV

SEQ ID NO: 30884 - protein, 164 aa, Homo sapiens
  Payload ID: 6063
  Gene Symbol: FADS1
  Gene Name: fatty acid desaturase 1
  ENSP ID: ENSP00000442170
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVE

SEQ ID NO: 30885 - protein, 112 aa, Homo sapiens
  Payload ID: 6063
  Gene Symbol: FADS1
  Gene Name: fatty acid desaturase 1
  ENSP ID: ENSP00000443037
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLL

SEQ ID NO: 30886 - protein, 124 aa, Homo sapiens
  Payload ID: 6063
  Gene Symbol: FADS1
  Gene Name: fatty acid desaturase 1
  ENSP ID: ENSP00000443587
MHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVT

SEQ ID NO: 30887 - protein, 146 aa, Homo sapiens
  Payload ID: 6063
  Gene Symbol: FADS1
  Gene Name: fatty acid desaturase 1
  ENSP ID: ENSP00000445253
MITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 30888 - protein, 16 aa, Homo sapiens
  Payload ID: 6063
  Gene Symbol: FADS1
  Gene Name: fatty acid desaturase 1
  ENSP ID: ENSP00000445442
MNSLLIGELSPEQPSF

SEQ ID NO: 30889 - protein, 110 aa, Homo sapiens
  Payload ID: 6063
  Gene Symbol: FADS1
  Gene Name: fatty acid desaturase 1
  ENSP ID: ENSP00000446270
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNH

SEQ ID NO: 30890 - protein, 422 aa, Homo sapiens
  Payload ID: 6064
  Gene Symbol: FADS2
  Gene Name: fatty acid desaturase 2
  Uniprot ID: O95864
  ENSP ID: ENSP00000257261
MHGREAGPFVCVCVLLASIPTPQTPLLQASLPPFHPASAGHPITGQQDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 30891 - protein, 444 aa, Homo sapiens
  Payload ID: 6064
  Gene Symbol: FADS2
  Gene Name: fatty acid desaturase 2
  Uniprot ID: O95864
  ENSP ID: ENSP00000278840
MGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 30892 - protein, 55 aa, Homo sapiens
  Payload ID: 6064
  Gene Symbol: FADS2
  Gene Name: fatty acid desaturase 2
  ENSP ID: ENSP00000428522
MDLITVHLLYGCPSLLHGPTLAGTVLGAAGDPRPWPVHASQPPYTGHPYVLPFRA

SEQ ID NO: 30893 - protein, 413 aa, Homo sapiens
  Payload ID: 6064
  Gene Symbol: FADS2
  Gene Name: fatty acid desaturase 2
  Uniprot ID: O95864
  ENSP ID: ENSP00000429500
MTREPPGCRRVNSLMLYTLRSITSHRSSHPERWATSSQDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 30894 - protein, 52 aa, Homo sapiens
  Payload ID: 6064
  Gene Symbol: FADS2
  Gene Name: fatty acid desaturase 2
  ENSP ID: ENSP00000429693
MTREPPGCRRVNSLMLYTLRSITSHRSSHPERWATSSQKRKKKTLMPIVMKP

SEQ ID NO: 30895 - protein, 103 aa, Homo sapiens
  Payload ID: 6064
  Gene Symbol: FADS2
  Gene Name: fatty acid desaturase 2
  ENSP ID: ENSP00000430054
MNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPN

SEQ ID NO: 30896 - protein, 93 aa, Homo sapiens
  Payload ID: 6064
  Gene Symbol: FADS2
  Gene Name: fatty acid desaturase 2
  ENSP ID: ENSP00000430225
MNLFKTNHVFFLLLLAHIIALESIAWFTVFYFGNGWIPTLITAFVLATSQAQAGWLQHDYGHLSVYRKPKWNHLVHKFVIGHLKGASANWWNH

SEQ ID NO: 30897 - protein, 386 aa, Homo sapiens
  Payload ID: 6064
  Gene Symbol: FADS2
  Gene Name: fatty acid desaturase 2
  Uniprot ID: O95864
  ENSP ID: ENSP00000431091
MGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHQ

SEQ ID NO: 30898 - protein, 151 aa, Homo sapiens
  Payload ID: 6064
  Gene Symbol: FADS2
  Gene Name: fatty acid desaturase 2
  ENSP ID: ENSP00000437965
MLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEH

SEQ ID NO: 30899 - protein, 95 aa, Homo sapiens
  Payload ID: 6064
  Gene Symbol: FADS2
  Gene Name: fatty acid desaturase 2
  ENSP ID: ENSP00000443867
MLHVFVLGEWQPIEYGKKKLKYLPYNHQHEYFFLIGPPLLIPMYFQYQIIMTMIVHKNWVDLAWAVSYYIRFFITYIPFYGILGALLFLNFIRCL

SEQ ID NO: 30900 - protein, 55 aa, Homo sapiens; identical to SEQ ID NO: 30892
  Payload ID: 6064
  Gene Symbol: FADS2
  Gene Name: fatty acid desaturase 2
  ENSP ID: ENSP00000458917

SEQ ID NO: 30901 - protein, 445 aa, Homo sapiens
  Payload ID: 6065
  Gene Symbol: FADS3
  Gene Name: fatty acid desaturase 3
  Uniprot ID: Q9Y5Q0
  ENSP ID: ENSP00000278829
MGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 30902 - protein, 330 aa, Homo sapiens
  Payload ID: 6065
  Gene Symbol: FADS3
  Gene Name: fatty acid desaturase 3
  ENSP ID: ENSP00000431533
MKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHQCQHTLPTPSLFPRMPRHNYSRVAPLVKSLCAKHGLSYEVKPFLTALVDIVRSLKKSGDIWLDAYLHQ

SEQ ID NO: 30903 - protein, 116 aa, Homo sapiens
  Payload ID: 6065
  Gene Symbol: FADS3
  Gene Name: fatty acid desaturase 3
  ENSP ID: ENSP00000432012
  MOD_RES (1)..(1): Any amino acid
XVRVLESHWFVWITQMNHIPKEIGHEKHRDWLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 30904 - protein, 417 aa, Homo sapiens
  Payload ID: 6065
  Gene Symbol: FADS3
  Gene Name: fatty acid desaturase 3
  ENSP ID: ENSP00000432206
MGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 30905 - protein, 188 aa, Homo sapiens
  Payload ID: 6065
  Gene Symbol: FADS3
  Gene Name: fatty acid desaturase 3
  ENSP ID: ENSP00000434551
MKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYL

SEQ ID NO: 30906 - protein, 229 aa, Homo sapiens
  Payload ID: 6065
  Gene Symbol: FADS3
  Gene Name: fatty acid desaturase 3
  ENSP ID: ENSP00000435597
  MOD_RES (1)..(1): Any amino acid
XNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHQCQHTLPTPSLFPRMPRHNYSRVAPLVKSLCAKHGLSYEVKPFLTALVDIVRSLKKSGDIWLDAYLHQ

SEQ ID NO: 30907 - protein, 199 aa, Homo sapiens
  Payload ID: 6065
  Gene Symbol: FADS3
  Gene Name: fatty acid desaturase 3
  ENSP ID: ENSP00000436890
MKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLF

SEQ ID NO: 30908 - protein, 219 aa, Homo sapiens
  Payload ID: 6066
  Gene Symbol: FADS6
  Gene Name: fatty acid desaturase 6
  ENSP ID: ENSP00000464267
TAFTAEHATHGHVKMHHAYTNVVGLGDSSTWRLPCLNRYVYMFLAPFLLPIATPLVAVERLRKVELGTALRTLALISLGLYSHYWLLLNVSGFKNPSSALGCMFLTRSLLAHPYLHVNIFQHIGLPMFSRDNKPRRIHMMSLGVLNLARLPVLDWAFGHSIISCHVEHHLFPRLSDNMCLKVVEGWAGGAGIKGLLEDGKEDSSAWGRCSHYNPGTCGG

SEQ ID NO: 30909 - protein, 350 aa, Homo sapiens
  Payload ID: 6066
  Gene Symbol: FADS6
  Gene Name: fatty acid desaturase 6
  ENSP ID: ENSP00000478413
MEPTEPMEPTEPMEPARSAHRGGEALLRELEVLVQDVVRTSSWWERHGVDCAILALSLFALPAGFLCLRWENALVFASGITILGVCHYTLTVKGSHLATHGALTESKRWSKIWLLFFVEVCTAFTAEHATHGHVKMHHAYTNVVGLGDSSTWRLPCLNRYVYMFLAPFLLPIATPLVAVERLRKVELGTALRTLALISLGLYSHYWLLLNVSGFKNPSSALGCMFLTRSLLAHPYLHVNIFQHIGLPMFSRDNKPRRIHMMSLGVLNLARLPVLDWAFGHSIISCHVEHHLFPRLSDNMCLKVKPVVSQFLREKQLPYNEDSYLARFQLFLRRYEEFMVQAPPITELVGL

SEQ ID NO: 30910 - protein, 123 aa, Homo sapiens
  Payload ID: 6066
  Gene Symbol: FADS6
  Gene Name: fatty acid desaturase 6
  ENSP ID: ENSP00000480385
MEPTEPMEPTEPMEPTEPMEPTEPMEPTEPMEPARSAHRGGEALLRELEVLVQDVVRTSSWWERHGVDCAILALSLFALPAGVHSLHCRARHAWARQDAPCLHQRGGPGGLQHVEAALPQPLC

SEQ ID NO: 30911 - protein, 368 aa, Homo sapiens
  Payload ID: 6066
  Gene Symbol: FADS6
  Gene Name: fatty acid desaturase 6
  ENSP ID: ENSP00000481684
MEPTEPMEPTEPMEPTEPMEPTEPMEPTEPMEPARSAHRGGEALLRELEVLVQDVVRTSSWWERHGVDCAILALSLFALPAGFLCLRWENALVFASGITILGVCHYTLTVKGSHLATHGALTESKRWSKIWLLFFVEVCTAFTAEHATHGHVKMHHAYTNVVGLGDSSTWRLPCLNRYVYMFLAPFLLPIATPLVAVERLRKVELGTALRTLALISLGLYSHYWLLLNVSGFKNPSSALGCMFLTRSLLAHPYLHVNIFQHIGLPMFSRDNKPRRIHMMSLGVLNLARLPVLDWAFGHSIISCHVEHHLFPRLSDNMCLKVKPVVSQFLREKQLPYNEDSYLARFQLFLRRYEEFMVQAPPITELVGL

SEQ ID NO: 30912 - protein, 333 aa, Homo sapiens
  Payload ID: 6067
  Gene Symbol: FAXDC2
  Gene Name: fatty acid hydroxylase domain containing 2
  Uniprot ID: Q96IV6
  ENSP ID: ENSP00000320604
MKGEAGHMLHNEKSKQEGHIWGSMRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHRLLHHPTFYKKIHKKHHEWTAPIGVISLYAHPIEHAVSNMLPVIVGPLVMGSHLSSITMWFSLALIITTISHCGYHLPFLPSPEFHDYHHLKFNQCYGVLGVLDHLHGTDTMFKQTKAYERHVLLLGFTPLSESIPDSPKRME

SEQ ID NO: 30913 - protein, 99 aa, Homo sapiens
  Payload ID: 6067
  Gene Symbol: FAXDC2
  Gene Name: fatty acid hydroxylase domain containing 2
  ENSP ID: ENSP00000428834
MRRTAFILGSGLLSFVAFWNSVTWHLQRFWGASGYFWQAQWERLLTTFEGKEWILFFIGGSCETAPVYPHSSFQPVHDIFPHGGLPLSLPQMVERPLPP

SEQ ID NO: 30914 - protein, 50 aa, Homo sapiens
  Payload ID: 6067
  Gene Symbol: FAXDC2
  Gene Name: fatty acid hydroxylase domain containing 2
  ENSP ID: ENSP00000428992
MKGEAGHMLHNEKSKQEGHIWGSMRRTAFILGSGLLSFVAFWNSVTWWIL

SEQ ID NO: 30915 - protein, 43 aa, Homo sapiens
  Payload ID: 6067
  Gene Symbol: FAXDC2
  Gene Name: fatty acid hydroxylase domain containing 2
  ENSP ID: ENSP00000429004
MRRTAFILGSGLLSFVAFWNSVTWCHPSALSLLLELQWASIGG

SEQ ID NO: 30916 - protein, 102 aa, Homo sapiens
  Payload ID: 6067
  Gene Symbol: FAXDC2
  Gene Name: fatty acid hydroxylase domain containing 2
  ENSP ID: ENSP00000429406
MKGEAGHMLHNEKSKQEGHIWGSMRRTAFILGSGLLSFVAFWNSVTWHLQRFWGASGYFWQAQWERLLTTFEGKEWILFFIGWRDLASQWDGSKQRVNSEIS

SEQ ID NO: 30917 - protein, 146 aa, Homo sapiens
  Payload ID: 6067
  Gene Symbol: FAXDC2
  Gene Name: fatty acid hydroxylase domain containing 2
  ENSP ID: ENSP00000429837
MRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFH

SEQ ID NO: 30918 - protein, 114 aa, Homo sapiens
  Payload ID: 6067
  Gene Symbol: FAXDC2
  Gene Name: fatty acid hydroxylase domain containing 2
  ENSP ID: ENSP00000429876
MRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPAGETWPRNGMEVNKE

SEQ ID NO: 30919 - protein, 310 aa, Homo sapiens
  Payload ID: 6067
  Gene Symbol: FAXDC2
  Gene Name: fatty acid hydroxylase domain containing 2
  Uniprot ID: Q96IV6
  ENSP ID: ENSP00000430286
MRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHRLLHHPTFYKKIHKKHHEWTAPIGVISLYAHPIEHAVSNMLPVIVGPLVMGSHLSSITMWFSLALIITTISHCGYHLPFLPSPEFHDYHHLKFNQCYGVLGVLDHLHGTDTMFKQTKAYERHVLLLGFTPLSESIPDSPKRME

SEQ ID NO: 30920 - protein, 31 aa, Homo sapiens
  Payload ID: 6067
  Gene Symbol: FAXDC2
  Gene Name: fatty acid hydroxylase domain containing 2
  ENSP ID: ENSP00000431015
MKGEAGHMLHNEKSKQEGHIWGSMRRTAFIL

SEQ ID NO: 30921 - protein, 60 aa, Homo sapiens
  Payload ID: 6067
  Gene Symbol: FAXDC2
  Gene Name: fatty acid hydroxylase domain containing 2
  ENSP ID: ENSP00000431084
MKGEAGHMLHNEKSKQVPSKCLVSSSGASMGFYWWLTQQENLTSSLATEFRSARMNLWIL

SEQ ID NO: 30922 - protein, 2511 aa, Homo sapiens
  Payload ID: 6068
  Gene Symbol: FASN
  Gene Name: fatty acid synthase
  Uniprot ID: P49327
  ENSP ID: ENSP00000304592
MEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIAAVPATAMPFRGYAVLGGERGGPEVQQVPAGERPLWFICSGMGTQWRGMGLSLMRLDRFRDSILRSDEAVKPFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPGVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIGRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARALGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 30923 - protein, 78 aa, Homo sapiens
  Payload ID: 6068
  Gene Symbol: FASN
  Gene Name: fatty acid synthase
  ENSP ID: ENSP00000462949
  MOD_RES (1)..(1): Any amino acid
XLASRLSIPTYGLQCTRGRCSPRAPTAWPATPTGPAWPLKCAPSCRPSRAQPPPTTASSCSTARPPTYWPTPRATGQS

SEQ ID NO: 30924 - protein, 2509 aa, Homo sapiens
  Payload ID: 6068
  Gene Symbol: FASN
  Gene Name: fatty acid synthase
  ENSP ID: ENSP00000488964
MEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIAAVPATAMPFRGYAVLGGERGGPEVQQVPAGERPLWFICSGMGTQWRGMGLSLMRLDRFRDSILRSDEAVKPFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPGVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIGRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARALGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 30925 - protein, 150 aa, Homo sapiens
  Payload ID: 6068
  Gene Symbol: FASN
  Gene Name: fatty acid synthase
  ENSP ID: ENSP00000489514
MEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDF

SEQ ID NO: 30926 - protein, 515 aa, Homo sapiens
  Payload ID: 6069
  Gene Symbol: FAR1
  Gene Name: fatty acyl CoA reductase 1
  Uniprot ID: Q8WVX9
  ENSP ID: ENSP00000346874
MVSIPEYYEGKNVLLTGATGFLGKVLLEKLLRSCPKVNSVYVLVRQKAGQTPQERVEEVLSGKLFDRLRDENPDFREKIIAINSELTQPKLALSEEDKEVIIDSTNIIFHCAATVRFNENLRDAVQLNVIATRQLILLAQQMKNLEVFMHVSTAYAYCNRKHIDEVVYPPPVDPKKLIDSLEWMDDGLVNDITPKLIGDRPNTYIYTKALAEYVVQQEGAKLNVAIVRPSIVGASWKEPFPGWIDNFNGPSGLFIAAGKGILRTIRASNNALADLVPVDVVVNMSLAAAWYSGVNRPRNIMVYNCTTGSTNPFHWGEVEYHVISTFKRNPLEQAFRRPNVNLTSNHLLYHYWIAVSHKAPAFLYDIYLRMTGRSPRMMKTITRLHKAMVFLEYFTSNSWVWNTENVNMLMNQLNPEDKKTFNIDVRQLHWAEYIENYCLGTKKYVLNEEMSGLPAARKHLNKLRNIRYGFNTILVILIWRIFIARSQMARNIWYFVVSLCYKFLSYFRASSTMRY

SEQ ID NO: 30927 - protein, 139 aa, Homo sapiens
  Payload ID: 6069
  Gene Symbol: FAR1
  Gene Name: fatty acyl CoA reductase 1
  ENSP ID: ENSP00000434624
MMKTITRLHKAMVFLEYFTSNSWVWNTENVNMLMNQLNPEDKKTFNIDVRQLHWAEYIENYCLGTKKYVLNEEMSGLPAARKHLNKLRNIRYGFNTILVILIWRIFIARSQMARNIWYFVVSLCYKFLSYFRASSTMRY

SEQ ID NO: 30928 - protein, 335 aa, Homo sapiens
  Payload ID: 6069
  Gene Symbol: FAR1
  Gene Name: fatty acyl CoA reductase 1
  ENSP ID: ENSP00000437111
MVSIPEYYEGKNVLLTGATGFLGKVLLEKLLRSCPKVNSVYVLVRQKAGQTPQERVEEVLSGKLFDRLRDENPDFREKIIAINSELTQPKLALSEEDKEVIIDSTNIIFHCAATVRFNENLRDAVQLNVIATRQLILLAQQMKNLEVFMHVSTAYAYCNRKHIDEVVYPPPVDPKKLIDSLEWMDDGLVNDITPKLIGDRPNTYIYTKALAEYVVQQEGAKLNVAIVRPSIVGASWKEPFPGWIDNFNGPSGLFIAAGKGILRTIRASNNALADLVPVDVVVNMSLAAAWYSGVNRPRNIMVYNCTTGSTNPFHWGEVGMILPVFLNVRINLKEP

SEQ ID NO: 30929 - protein, 515 aa, Homo sapiens
  Payload ID: 6070
  Gene Symbol: FAR2
  Gene Name: fatty acyl CoA reductase 2
  Uniprot ID: Q96K12
  ENSP ID: ENSP00000182377
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 30930 - protein, 515 aa, Homo sapiens; identical to SEQ ID NO: 30929
  Payload ID: 6070
  Gene Symbol: FAR2
  Gene Name: fatty acyl CoA reductase 2
  Uniprot ID: Q96K12
  ENSP ID: ENSP00000443291

SEQ ID NO: 30931 - protein, 22 aa, Homo sapiens
  Payload ID: 6070
  Gene Symbol: FAR2
  Gene Name: fatty acyl CoA reductase 2
  ENSP ID: ENSP00000447467
  MOD_RES (1)..(1): Any amino acid
XMAGIPKAKQRLKRSCTPYSTL

SEQ ID NO: 30932 - protein, 85 aa, Homo sapiens
  Payload ID: 6070
  Gene Symbol: FAR2
  Gene Name: fatty acyl CoA reductase 2
  ENSP ID: ENSP00000449187
LSPEDQRVFNFDVRQLNWLEYIENYVLGVKKYLLKEDMAGIPKAKQRLKRLRNIHYLFNTALFLIAWRLLIARSQMARNVWFFIM

SEQ ID NO: 30933 - protein, 418 aa, Homo sapiens
  Payload ID: 6070
  Gene Symbol: FAR2
  Gene Name: fatty acyl CoA reductase 2
  Uniprot ID: Q96K12
  ENSP ID: ENSP00000449349
MQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 30934 - protein, 67 aa, Homo sapiens
  Payload ID: 6070
  Gene Symbol: FAR2
  Gene Name: fatty acyl CoA reductase 2
  ENSP ID: ENSP00000449436
MSTIAAFYGGKSILITGATGFLGKVLMEKLFRTSPDLKVIYILVRPKAGQTLQQRVFQILDSKFESY

SEQ ID NO: 30935 - protein, 44 aa, Homo sapiens
  Payload ID: 6070
  Gene Symbol: FAR2
  Gene Name: fatty acyl CoA reductase 2
  ENSP ID: ENSP00000450117
MQELLSCTNIIFHCAATVRFDDTLRHAVQLNVTATRQLLLMASQ

SEQ ID NO: 30936 - protein, 380 aa, Homo sapiens
  Payload ID: 6071
  Gene Symbol: FOS
  Gene Name: FBJ murine osteosarcoma viral oncogene homolog
  Uniprot ID: P01100
  ENSP ID: ENSP00000306245
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 30937 - protein, 344 aa, Homo sapiens
  Payload ID: 6071
  Gene Symbol: FOS
  Gene Name: FBJ murine osteosarcoma viral oncogene homolog
  Uniprot ID: P01100
  ENSP ID: ENSP00000442268
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 30938 - protein, 170 aa, Homo sapiens
  Payload ID: 6071
  Gene Symbol: FOS
  Gene Name: FBJ murine osteosarcoma viral oncogene homolog
  ENSP ID: ENSP00000450519
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQVRNSSVLFLGMWGLGGKQPRRCRSPVQRMKPLMGLAAHP

SEQ ID NO: 30939 - protein, 232 aa, Homo sapiens
  Payload ID: 6071
  Gene Symbol: FOS
  Gene Name: FBJ murine osteosarcoma viral oncogene homolog
  ENSP ID: ENSP00000450886
MAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 30940 - protein, 83 aa, Homo sapiens
  Payload ID: 6071
  Gene Symbol: FOS
  Gene Name: FBJ murine osteosarcoma viral oncogene homolog
  ENSP ID: ENSP00000451786
RLLRGPIADQSPSPFRSPRPLRWGLLQGWRCEDHDRRPSAEHWQEGQGGTEEEEKRRIRRERNKMAAAKCRNRRRELTDTLQA

SEQ ID NO: 30941 - protein, 176 aa, Homo sapiens
  Payload ID: 6071
  Gene Symbol: FOS
  Gene Name: FBJ murine osteosarcoma viral oncogene homolog
  ENSP ID: ENSP00000452386
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAVGTLWVAPF

SEQ ID NO: 30942 - protein, 142 aa, Homo sapiens
  Payload ID: 6071
  Gene Symbol: FOS
  Gene Name: FBJ murine osteosarcoma viral oncogene homolog
  ENSP ID: ENSP00000452440
MTGGRAQSIGRRGKVEQETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDM

SEQ ID NO: 30943 - protein, 137 aa, Homo sapiens
  Payload ID: 6071
  Gene Symbol: FOS
  Gene Name: FBJ murine osteosarcoma viral oncogene homolog
  ENSP ID: ENSP00000452443
MMFSGFNADYEASSSRCSSASPAGDSLSYYHSPADSFSSMGSPVNAQCQLHSHGHCHLDQSGPAVAGAARPRLLRGPIADQSPSPFRSPRPLRWGLLQGWRCEDHDRRPSAEHWQEGQGGTVISRRRREKENPKGKE

SEQ ID NO: 30944 - protein, 266 aa, Homo sapiens
  Payload ID: 6071
  Gene Symbol: FOS
  Gene Name: FBJ murine osteosarcoma viral oncogene homolog
  Uniprot ID: P01100
  ENSP ID: ENSP00000452590
MTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 30945 - protein, 338 aa, Homo sapiens
  Payload ID: 6072
  Gene Symbol: FOSB
  Gene Name: FBJ murine osteosarcoma viral oncogene homolog B
  Uniprot ID: P53539
  ENSP ID: ENSP00000245919
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 30946 - protein, 302 aa, Homo sapiens
  Payload ID: 6072
  Gene Symbol: FOSB
  Gene Name: FBJ murine osteosarcoma viral oncogene homolog B
  Uniprot ID: P53539
  ENSP ID: ENSP00000407207
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 30947 - protein, 195 aa, Homo sapiens
  Payload ID: 6072
  Gene Symbol: FOSB
  Gene Name: FBJ murine osteosarcoma viral oncogene homolog B
  Uniprot ID: P53539
  ENSP ID: ENSP00000414177
MFQAFPGDYDSGSRCSSSPSAESQYLSSVDSFGSPPTAAASQETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 30948 - protein, 177 aa, Homo sapiens
  Payload ID: 6072
  Gene Symbol: FOSB
  Gene Name: FBJ murine osteosarcoma viral oncogene homolog B
  ENSP ID: ENSP00000465068
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETVSKGHQNLAWVGGSKRGRKFLMNGGGLH

SEQ ID NO: 30949 - protein, 137 aa, Homo sapiens
  Payload ID: 6072
  Gene Symbol: FOSB
  Gene Name: FBJ murine osteosarcoma viral oncogene homolog B
  ENSP ID: ENSP00000465528
MPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAE

SEQ ID NO: 30950 - protein, 237 aa, Homo sapiens
  Payload ID: 6072
  Gene Symbol: FOSB
  Gene Name: FBJ murine osteosarcoma viral oncogene homolog B
  ENSP ID: ENSP00000465552
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAE

SEQ ID NO: 30951 - protein, 299 aa, Homo sapiens
  Payload ID: 6072
  Gene Symbol: FOSB
  Gene Name: FBJ murine osteosarcoma viral oncogene homolog B
  Uniprot ID: P53539
  ENSP ID: ENSP00000466530
MFQAFPGDYDSGSRCSSSPSAESQYLSSVDSFGSPPTAAASQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 30952 - protein, 263 aa, Homo sapiens
  Payload ID: 6072
  Gene Symbol: FOSB
  Gene Name: FBJ murine osteosarcoma viral oncogene homolog B
  Uniprot ID: P53539
  ENSP ID: ENSP00000467497
MFQAFPGDYDSGSRCSSSPSAESQYLSSVDSFGSPPTAAASQSQGQPLASQPPVVDPYDMPGTSYSTPGMSGYSSGGASGSGGPSTSGTTSGPGPARPARARPRRPREETETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 30953 - protein, 289 aa, Homo sapiens
  Payload ID: 6072
  Gene Symbol: FOSB
  Gene Name: FBJ murine osteosarcoma viral oncogene homolog B
  Uniprot ID: P53539
  ENSP ID: ENSP00000468207
MPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 30954 - protein, 188 aa, Homo sapiens
  Payload ID: 6072
  Gene Symbol: FOSB
  Gene Name: FBJ murine osteosarcoma viral oncogene homolog B
  ENSP ID: ENSP00000468482
MPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAE

SEQ ID NO: 30955 - protein, 291 aa, Homo sapiens
  Payload ID: 6072
  Gene Symbol: FOSB
  Gene Name: FBJ murine osteosarcoma viral oncogene homolog B
  Uniprot ID: P53539
  ENSP ID: ENSP00000485018
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEEVQVLGDPFPVVNPSYTSSFVLTCPEVSAFAGAQRTSGSDQPSDPLNSPSLLAL

SEQ ID NO: 30956 - protein, 326 aa, Homo sapiens
  Payload ID: 6073
  Gene Symbol: FBXL12
  Gene Name: F-box and leucine-rich repeat protein 12
  Uniprot ID: Q9NXK8
  ENSP ID: ENSP00000247977
MATLVELPDSVLLEIFSYLPVRDRIRISRVCHRWKRLVDDRWLWRHVDLTLYTMRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 30957 - protein, 55 aa, Homo sapiens
  Payload ID: 6073
  Gene Symbol: FBXL12
  Gene Name: F-box and leucine-rich repeat protein 12
  ENSP ID: ENSP00000464784
MATLVELPDSVLLEIFSYLPGLSPLEEAGGRPVAVATCRPDALHGPMMPSREIQQ

SEQ ID NO: 30958 - protein, 55 aa, Homo sapiens
  Payload ID: 6073
  Gene Symbol: FBXL12
  Gene Name: F-box and leucine-rich repeat protein 12
  ENSP ID: ENSP00000464858
MATLVELPDSVLLEIFSYLPVRDRIRISRVCHRWKRLVDDRWLWRHVDLTLYTAL

SEQ ID NO: 30959 - protein, 134 aa, Homo sapiens
  Payload ID: 6073
  Gene Symbol: FBXL12
  Gene Name: F-box and leucine-rich repeat protein 12
  ENSP ID: ENSP00000465439
MATLVELPDSVLLEIFSYLPVRDRIRISRVCHRWKRLVDDRWLWRHVDLTLYTVRAAGRAGLGRGRGARTPKTTSPTLGLCVGARAGDLEPGDPGPISASSLTSSSSTSGPQFPHPCNGDKGQYLPHGAIMGLH

SEQ ID NO: 30960 - protein, 53 aa, Homo sapiens
  Payload ID: 6073
  Gene Symbol: FBXL12
  Gene Name: F-box and leucine-rich repeat protein 12
  ENSP ID: ENSP00000466142
MATLVELPDSVLLEIFSYLPVRDRIRISRVCHRWKRLVDDRWLWRHVDLTLYT

SEQ ID NO: 30961 - protein, 85 aa, Homo sapiens
  Payload ID: 6073
  Gene Symbol: FBXL12
  Gene Name: F-box and leucine-rich repeat protein 12
  ENSP ID: ENSP00000467059
MATLVELPDSVLLEIFSYLPVRDRIRISRCGPASGGKGRAEGAAGTWRCDVARGWGRSNRASPPPGSVTAGRGWWTTGGCGDMST

SEQ ID NO: 30962 - protein, 273 aa, Homo sapiens
  Payload ID: 6073
  Gene Symbol: FBXL12
  Gene Name: F-box and leucine-rich repeat protein 12
  Uniprot ID: Q9NXK8
  ENSP ID: ENSP00000467359
MRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 30963 - protein, 88 aa, Homo sapiens
  Payload ID: 6073
  Gene Symbol: FBXL12
  Gene Name: F-box and leucine-rich repeat protein 12
  ENSP ID: ENSP00000467467
MRPKVMWHLLRRYMASRLHSLRMGGYLFSGSQAPQLSPALLRALGQKCPNLKRLCLHVADLSMVPITSLPSTLRTLELHSCEISMAWL

SEQ ID NO: 30964 - protein, 85 aa, Homo sapiens; identical to SEQ ID NO: 30961
  Payload ID: 6073
  Gene Symbol: FBXL12
  Gene Name: F-box and leucine-rich repeat protein 12
  ENSP ID: ENSP00000467523

SEQ ID NO: 30965 - protein, 69 aa, Homo sapiens
  Payload ID: 6073
  Gene Symbol: FBXL12
  Gene Name: F-box and leucine-rich repeat protein 12
  ENSP ID: ENSP00000467859
MATLVELPDSVLLEIFSYLPVRDRIRISRCDLKSCGTSFEGTWHPGSIPCGWVATCSLAPRPPSCPLLC

SEQ ID NO: 30966 - protein, 47 aa, Homo sapiens
  Payload ID: 6073
  Gene Symbol: FBXL12
  Gene Name: F-box and leucine-rich repeat protein 12
  ENSP ID: ENSP00000468033
MATLVELPDSVLLEIFSYLPGLSPLEEAGGRPVAVATCRPDALHDAT

SEQ ID NO: 30967 - protein, 273 aa, Homo sapiens; identical to SEQ ID NO: 30962
  Payload ID: 6073
  Gene Symbol: FBXL12
  Gene Name: F-box and leucine-rich repeat protein 12
  Uniprot ID: Q9NXK8
  ENSP ID: ENSP00000468369

SEQ ID NO: 30968 - protein, 41 aa, Homo sapiens
  Payload ID: 6073
  Gene Symbol: FBXL12
  Gene Name: F-box and leucine-rich repeat protein 12
  ENSP ID: ENSP00000468766
  MOD_RES (1)..(1): Any amino acid
XVLLEIFSYLPGLSPLEEAGGRPVAVATCRPDALHGWSAVV

SEQ ID NO: 30969 - protein, 735 aa, Homo sapiens
  Payload ID: 6074
  Gene Symbol: FBXL13
  Gene Name: F-box and leucine-rich repeat protein 13
  Uniprot ID: Q8NEE6
  ENSP ID: ENSP00000321927
MTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIRFEGNKRVTDASFKFIDKNYPNLSHIYMADCKGITDSSLRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEGLNVLSRHKKLKELSVSECYRITDDGIQAFCKSSLILEHLDVSYCSQLSDMIIKALAIYCINLTSLSIAGCPKITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 30970 - protein, 707 aa, Homo sapiens
  Payload ID: 6074
  Gene Symbol: FBXL13
  Gene Name: F-box and leucine-rich repeat protein 13
  Uniprot ID: Q8NEE6
  ENSP ID: ENSP00000368607
MTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIRFEGNKRVTDASFKFIDKNYPNLSHIYMADCKGITDSSLRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEAFCKSSLILEHLDVSYCSQLSDMIIKALAIYCINLTSLSIAGCPKITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 30971 - protein, 683 aa, Homo sapiens [sequence omitted]

SEQ ID NO: 30972 - protein, 735 aa, Homo sapiens; identical to SEQ ID NO: 30969
  Payload ID: 6074
  Gene Symbol: FBXL13
  Gene Name: F-box and leucine-rich repeat protein 13
  Uniprot ID: Q8NEE6
  ENSP ID: ENSP00000388608

SEQ ID NO: 30973 - protein, 210 aa, Homo sapiens
  Payload ID: 6074
  Gene Symbol: FBXL13
  Gene Name: F-box and leucine-rich repeat protein 13
  ENSP ID: ENSP00000390126
MASLRNANPRLKNYFKENYIPQVCEALLCGILVTCPEDPLRYLEGMIMVIIKSGLQNLLWDMCITPSMKPNIRRLSETYLEQLFELDDQLMTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKW

SEQ ID NO: 30974 - protein, 690 aa, Homo sapiens
  Payload ID: 6074
  Gene Symbol: FBXL13
  Gene Name: F-box and leucine-rich repeat protein 13
  Uniprot ID: Q8NEE6
  ENSP ID: ENSP00000391550
MTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIRFEGNKRVTDASFKFIDKNYPNLSHIYMADCKGITDSSLRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEGLNVLSRHKKLKELSVSECYRITDDGIQITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 30975 - protein, 684 aa, Homo sapiens
  Payload ID: 6074
  Gene Symbol: FBXL13
  Gene Name: F-box and leucine-rich repeat protein 13
  ENSP ID: ENSP00000405434
MASLRNANPRLKNYFKENYIPQVCEALLCGILVTCPEDPLRYLEGMIMVIIKSGLQNLLWDMCITPSMKPNIRRLSETYLEQLFELDDQLMTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIRFEGNKRVTDASFKFIDKNYPNLSHIYMADCKGITDSSLRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEGLNVLSRHKKLKELSVSECYRITDDGIQIARMEASANKEGLPKTPIADY

SEQ ID NO: 30976 - protein, 453 aa, Homo sapiens
  Payload ID: 6074
  Gene Symbol: FBXL13
  Gene Name: F-box and leucine-rich repeat protein 13
  Uniprot ID: Q8NEE6
  ENSP ID: ENSP00000409716
MTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 30977 - protein, 418 aa, Homo sapiens
  Payload ID: 6075
  Gene Symbol: FBXL14
  Gene Name: F-box and leucine-rich repeat protein 14
  Uniprot ID: Q8N1E6
  ENSP ID: ENSP00000344855
METHISCLFPELLAMIFGYLDVRDKGRAAQVCTAWRDAAYHKSVWRGVEAKLHLRRANPSLFPSLQARGIRRVQILSLRRSLSYVIQGMANIESLNLSGCYNLTDNGLGHAFVQEIGSLRALNLSLCKQITDSSLGRIAQYLKGLEVLELGGCSNITNTGLLLIAWGLQRLKSLNLRSCRHLSDVGIGHLAGMTRSAAEGCLGLEQLTLQDCQKLTDLSLKHISRGLTGLRLLNLSFCGGISDAGLLHLSHMGSLRSLNLRSCDNISDTGIMHLAMGSLRLSGLDVSFCDKVGDQSLAYIAQGLDGLKSLSLCSCHISDDGINRMVRQMHGLRTLNIGQCVRITDKGLELIAEHLSQLTGIDLYGCTRITKRGLERITQLPCLKVLNLGLWQMTDSEKEARGDFSPLFTVRTRGSSRR

SEQ ID NO: 30978 - protein, 300 aa, Homo sapiens
  Payload ID: 6076
  Gene Symbol: FBXL15
  Gene Name: F-box and leucine-rich repeat protein 15
  Uniprot ID: Q9H469
  ENSP ID: ENSP00000224862
MEPPMEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGDAAVQELARNCPELHHLDLTGCLRVGSDGVRTLAEYCPVLRSLRVRHCHHVAESSLSRLRKRGVDIDVEPPLHQALVLLQDMAGFAPFVNLQV

SEQ ID NO: 30979 - protein, 296 aa, Homo sapiens
  Payload ID: 6076
  Gene Symbol: FBXL15
  Gene Name: F-box and leucine-rich repeat protein 15
  ENSP ID: ENSP00000358972
MEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGDAAVQELARNCPELHHLDLTGCLRVGSDGVRTLAEYCPVLRSLRVRHCHHVAESSLSRLRKRGVDIDVEPPLHQALVLLQDMAGFAPFVNLQV

SEQ ID NO: 30980 - protein, 157 aa, Homo sapiens
  Payload ID: 6076
  Gene Symbol: FBXL15
  Gene Name: F-box and leucine-rich repeat protein 15
  ENSP ID: ENSP00000392215
MRSGFRCDEPAEAVAPERQTVSGAVALASFTSPHTHPVDDGGRHYSWGSPKRILGLGPGDAAKEAGLVRPLQGQSEKILLRTRNRQPMEPPMEPSGGEQEPGAVRFLDLPWEDVLLPHVLNRVPLRQLLRLQRVSRAFRSLVQLHLAGLRRFDAAQV

SEQ ID NO: 30981 - protein, 203 aa, Homo sapiens
  Payload ID: 6076
  Gene Symbol: FBXL15
  Gene Name: F-box and leucine-rich repeat protein 15
  ENSP ID: ENSP00000403646
MEPPMEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVN

SEQ ID NO: 30982 - protein, 208 aa, Homo sapiens
  Payload ID: 6076
  Gene Symbol: FBXL15
  Gene Name: F-box and leucine-rich repeat protein 15
  ENSP ID: ENSP00000405961
MEPPMEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGD

SEQ ID NO: 30983 - protein, 190 aa, Homo sapiens
  Payload ID: 6076
  Gene Symbol: FBXL15
  Gene Name: F-box and leucine-rich repeat protein 15
  ENSP ID: ENSP00000411435
MEPPMEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQR

SEQ ID NO: 30984 - protein, 479 aa, Homo sapiens
  Payload ID: 6077
  Gene Symbol: FBXL16
  Gene Name: F-box and leucine-rich repeat protein 16
  Uniprot ID: Q8N461
  ENSP ID: ENSP00000318674
MSSPGIDGDPKPPCLPRNGLVKLPGQPNGLGAASITKGTPATKNRPCQPPPPPTLPPPSLAAPLSRAALAGGPCTPAGGPASALAPGHPAERPPLATDEKILNGLFWYFSACEKCVLAQVCKAWRRVLYQPKFWAGLTPVLHAKELYNVLPGGEKEFVNLQGFAARGFEGFCLVGVSDLDICEFIDNYALSKKGVKAMSLKRSTITDAGLEVMLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRCVRITDTGLSYLSTMSSLRSLYLRWCCQVQDFGLKHLLALGSLRLLSLAGCPLLTTTGLSGLVQLQELEELELTNCPGATPELFKYFSQHLPRCLVIE

SEQ ID NO: 30985 - protein, 479 aa, Homo sapiens; identical to SEQ ID NO: 30984
  Payload ID: 6077
  Gene Symbol: FBXL16
  Gene Name: F-box and leucine-rich repeat protein 16
  Uniprot ID: Q8N461
  ENSP ID: ENSP00000380746

SEQ ID NO: 30986 - protein, 267 aa, Homo sapiens
  Payload ID: 6077
  Gene Symbol: FBXL16
  Gene Name: F-box and leucine-rich repeat protein 16
  Uniprot ID: Q8N461
  ENSP ID: ENSP00000455217
MLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRCVRITDTGLSYLSTMSSLRSLYLRWCCQVQDFGLKHLLALGSLRLLSLAGCPLLTTTGLSGLVQLQELEELELTNCPGATPELFKYFSQHLPRCLVIE

SEQ ID NO: 30987 - protein, 303 aa, Homo sapiens
  Payload ID: 6078
  Gene Symbol: FBXL17
  Gene Name: F-box and leucine-rich repeat protein 17
  Uniprot ID: Q9UF56
  ENSP ID: ENSP00000352683
MSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVNEVTVEQLVQQYPHITFSTVLQDCKRTLERAYQMGWTPNMSAASS

SEQ ID NO: 30988 - protein, 314 aa, Homo sapiens
  Payload ID: 6078
  Gene Symbol: FBXL17
  Gene Name: F-box and leucine-rich repeat protein 17
  Uniprot ID: Q9UF56
  ENSP ID: ENSP00000418111
MSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVRVDYQVVCFLHISIVNSLMSYPLSFSISTPVYYILYIHFICIYAIIAMHCLPAFVN

SEQ ID NO: 30989 - protein, 701 aa, Homo sapiens
  Payload ID: 6078
  Gene Symbol: FBXL17
  Gene Name: F-box and leucine-rich repeat protein 17
  Uniprot ID: Q9UF56
  ENSP ID: ENSP00000437464
MGHLLSKEPRNRPSQKRPRCCSWCRRRRPLLRLPRRTPAKVPPQPAAPRSRDCFFRGPCMLCFIVHSPGAPAPAGPEEEPPLSPPPRDGAYAAASSSQHLARRYAALAAEDCAAAARRFLLSSAAAAAAAAASASSPASCCKELGLAAAAAWEQQGRSLFLASLGPVRFLGPPAAVQLFRGPTPSPAELPTPPEMVCKRKGAGVPACTPCKQPRCGGGGCGGGGGGGGGGGPAGGGASPPRPPDAGCCQAPEQPPQPLCPPPSSPTSEGAPTEAGGDAVRAGGTAPLSAQQQHECGDADCRESPENPCDCHREPPPETPDINQLPPSILLKIFSNLSLDERCLSASLVCKYWRDLCLDFQFWKQLDLSSRQQVTDELLEKIASRSQNIIEINISDCRSMSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVNEVTVEQLVQQYPHITFSTVLQDCKRTLERAYQMGWTPNMSAASS

SEQ ID NO: 30990 - protein, 463 aa, Homo sapiens
  Payload ID: 6078
  Gene Symbol: FBXL17
  Gene Name: F-box and leucine-rich repeat protein 17
  ENSP ID: ENSP00000481439
MVCKRKGAGVPACTPCKQPLCPPPSSPTSEGAPTEAGGDAVRAGGTAPLSAQQQHECGDADCRESPENPCDCHREPPPETPDINQLPPSILLKIFSNLSLDERCLSASLVCKYWRDLCLDFQFWKQLDLSSRQQVTDELLEKIASRSQNIIEINISDCRSMSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVNEVTVEQLVQQYPHITFSTVLQDCKRTLERAYQMGWTPNMSAASS

SEQ ID NO: 30991 - protein, 718 aa, Homo sapiens
  Payload ID: 6079
  Gene Symbol: FBXL18
  Gene Name: F-box and leucine-rich repeat protein 18
  Uniprot ID: Q96ME1
  ENSP ID: ENSP00000371805
MASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLLRKAEDDIDSSILETLVASCCNLRHLNLSAAHHHSSEGLGRHLCQLLARLRHLRSLSLPVCSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRSFQAERPALNVVIFPLLHEGLTDVIRDVPLVHLDEITLFKSRVAEEPPNLWW

SEQ ID NO: 30992 - protein, 685 aa, Homo sapiens
  Payload ID: 6079
  Gene Symbol: FBXL18
  Gene Name: F-box and leucine-rich repeat protein 18
  ENSP ID: ENSP00000405896
  MOD_RES (1)..(1): Any amino acid
XCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLLRKAEDDIDSSILETLVASCCNLRHLNLSAAHHHSSEGLGRHLCQLLARLRHLRSLSLPVCSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRRWGEVTGRRPQLFTELREEPSARTSRATGRRQPCLPDSGVVCCPCGRPLAVSGIILVGVSPSLVVKTTCVYRVLFKNLDYASIFFLVCLFETESHSVVQAGVQWRDLSSLQPLLSGLQPQPPEQLGLQVCTTIPG

SEQ ID NO: 30993 - protein, 668 aa, Homo sapiens
  Payload ID: 6079
  Gene Symbol: FBXL18
  Gene Name: F-box and leucine-rich repeat protein 18
  Uniprot ID: Q96ME1
  ENSP ID: ENSP00000415064
MASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLLRKAEDDIDSSILETLVASCCNLRHLNLSAAHHHSSEGLGRHLCQLLARLRHLRSLSLPVCSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRSR

SEQ ID NO: 30994 - protein, 365 aa, Homo sapiens
  Payload ID: 6079
  Gene Symbol: FBXL18
  Gene Name: F-box and leucine-rich repeat protein 18
  Uniprot ID: Q96ME1
  ENSP ID: ENSP00000444797
MASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLLCR

SEQ ID NO: 30995 - protein, 259 aa, Homo sapiens
  Payload ID: 6079
  Gene Symbol: FBXL18
  Gene Name: F-box and leucine-rich repeat protein 18
  ENSP ID: ENSP00000481397
MHAVPRGFGKKVRVGVQSCPPLLGPGVPPALLRVLVSAEEPALPGTPRADWVQLLLRHAPQRARHPQLAPTLQPRTECRGLGGGRHRPAGLPAAPDARTAAQRPYGLRAGQYRPAVPAVAVPVAGQPGHDGEGGVHARALRHVEALQAAEGPQAGAALLQRQRPVLPGAEPVPLAAAPVPGLSQRHPPARCRAGLHGSLPAGCHVPPVHRGVPRHLQEPAAVASPQLPGRAARVKRRHLPSAPRGPDRRHPGRPPGAPG

SEQ ID NO: 30996 - protein, 674 aa, Homo sapiens
  Payload ID: 6080
  Gene Symbol: FBXL19
  Gene Name: F-box and leucine-rich repeat protein 19
  ENSP ID: ENSP00000339712
MSSSSRGPGAGARRRRTRCRRCRACVRTECGDCHFCRDMKKFGGPGRMKQSCLLRQCTAPVLPHTAVCLLCGEAGKEDTVEGEEEKFGLSLMECTICNEIVHPGCLKMGKAEGVINAEIPNCWECPRCTQEGRTSKDSGEGPGRRRADNGEEGASLGSGWKLTEEPPLPPPPPRRKGPLPAGPPPEDVPGPPKRKEREAGNEPPTPRKKVKGGRERHLKKVGGDACLLRGSDPGGPGLLPPRVLNPSQAFSSCHPGLPPENWEKPKPPLASAEGPAVPSPSPQREKLERFKRMCQLLERVPDTSSSSSDSDSDSDSSGTSLSEDEAPGEARNGRRPARGSSGEKENRGGRRAVRPGSGGPLLSWPLGPAPPPRPPQLERHVVRPPPRSPEPDTLPLAAGSDHPLPRAAWLRVFQHLGPRELCICMRVCRTWSRWCYDKRLWPRMDLSRRKSLTPPMLSGVVRRQPRALDLSWTGVSKKQLMWLLNRLQGLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGCHRLTDHCLPLFRRCPRLRRLDLRSCRQLSPEACARLAAAGPPGPFRCPEEKLLLKDS

SEQ ID NO: 30997 - protein, 694 aa, Homo sapiens
  Payload ID: 6080
  Gene Symbol: FBXL19
  Gene Name: F-box and leucine-rich repeat protein 19
  Uniprot ID: Q6PCT2
  ENSP ID: ENSP00000369666
MGMKVPGKGESGPSALLTPPMSSSSRGPGAGARRRRTRCRRCRACVRTECGDCHFCRDMKKFGGPGRMKQSCLLRQCTAPVLPHTAVCLLCGEAGKEDTVEGEEEKFGLSLMECTICNEIVHPGCLKMGKAEGVINAEIPNCWECPRCTQEGRTSKDSGEGPGRRRADNGEEGASLGSGWKLTEEPPLPPPPPRRKGPLPAGPPPEDVPGPPKRKEREAGNEPPTPRKKVKGGRERHLKKVGGDACLLRGSDPGGPGLLPPRVLNPSQAFSSCHPGLPPENWEKPKPPLASAEGPAVPSPSPQREKLERFKRMCQLLERVPDTSSSSSDSDSDSDSSGTSLSEDEAPGEARNGRRPARGSSGEKENRGGRRAVRPGSGGPLLSWPLGPAPPPRPPQLERHVVRPPPRSPEPDTLPLAAGSDHPLPRAAWLRVFQHLGPRELCICMRVCRTWSRWCYDKRLWPRMDLSRRKSLTPPMLSGVVRRQPRALDLSWTGVSKKQLMWLLNRLQGLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGCHRLTDHCLPLFRRCPRLRRLDLRSCRQLSPEACARLAAAGPPGPFRCPEEKLLLKDS

SEQ ID NO: 30998 - protein, 586 aa, Homo sapiens
  Payload ID: 6080
  Gene Symbol: FBXL19
  Gene Name: F-box and leucine-rich repeat protein 19
  ENSP ID: ENSP00000397913
  MOD_RES (1)..(1): Any amino acid
XRMKQSCLLRQCTAPVLPHTAVCLLCGEAGKEDTVEGEEEKFGLSLMECTICNEIVHPGCLKMGKAEGVINAEIPNCWECPRCTQEGRTSKDSGEGPGRRRADNGEEGASLGSGWKLTEEPPLPPPPPRRKGPLPAGPPPEDVPGPPKRKEREAGNEPPTPRKKVKGGRERHLKKKPKPPLASAEGPAVPSPSPQREKLERFKRMCQLLERVPDTSSSSSDSDSDSDSSGTSLSEDEAPGEARNGRRPARGSSGEKENRGGRRAVRPGSGGPLLSWPLGPAPPPRPPQLERHVVRPPPRSPEPDTLPLAAGSDHPLPRAAWLRVFQHLGPRELCICMRVCRTWSRWCYDKRLWPRMDLSRRKSLTPPMLSGVVRRQPRALDLSWTGVSKKQLMWLLNRLQGLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGCHRLTDHCLPLFRRCPRLRRLDLRSCRQLSPEACARLAAAGPPGPFRCPEEKLLLKDS

SEQ ID NO: 30999 - protein, 558 aa, Homo sapiens
  Payload ID: 6080
  Gene Symbol: FBXL19
  Gene Name: F-box and leucine-rich repeat protein 19
  ENSP ID: ENSP00000454344
MSSSSRGPGAGARRRRTRCRRCRACVRTECGDCHFCRDMKKFGGPGRMKQSCLLRQCTAPVLPHTAVCLLCGEAGKEDTVEGEEEKFGLSLMECTICNEIVHPGCLKMGKAEGVINAEIPNCWECPRCTQEGRTSKVKGGRERHLKKKPKPPLASAEGPAVPSPSPQREKLERFKRMCQLLERVPDTSSSSSDSDSDSDSSGTSLSEDEAPGEARNGRRPARGSSGEKENRGGRRAVRPGSGGPLLSWPLGPAPPPRPPQLERHVVRPPPRSPEPDTLPLAAGSDHPLPRAAWLRVFQHLGPRELCICMRVCRTWSRWCYDKRLWPRMDLSRRKSLTPPMLSGVVRRQPRALDLSWTGVSKKQLMWLLNRLQGLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGCHRLTDHCLPLFRRCPRLRRLDLRSCRQLSPEACARLAAAGPPGPFRCPEEKLLLKDS

SEQ ID NO: 31000 - protein, 138 aa, Homo sapiens
  Payload ID: 6080
  Gene Symbol: FBXL19
  Gene Name: F-box and leucine-rich repeat protein 19
  ENSP ID: ENSP00000455337
  MOD_RES (1)..(1): Any amino acid
XLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGFSSFPLTLTP

SEQ ID NO: 31001 - protein, 674 aa, Homo sapiens; identical to SEQ ID NO: 30996
  Payload ID: 6080
  Gene Symbol: FBXL19
  Gene Name: F-box and leucine-rich repeat protein 19
  ENSP ID: ENSP00000455529

SEQ ID NO: 31002 - protein, 59 aa, Homo sapiens
  Payload ID: 6080
  Gene Symbol: FBXL19
  Gene Name: F-box and leucine-rich repeat protein 19
  ENSP ID: ENSP00000455871
MSSSSRGPGAGARRRRTRCRRCRACVRTECGDCHFCRDMKKFGGPGRMKQSCLLRQCTA

SEQ ID NO: 31003 - protein, 122 aa, Homo sapiens
  Payload ID: 6080
  Gene Symbol: FBXL19
  Gene Name: F-box and leucine-rich repeat protein 19
  ENSP ID: ENSP00000457199
  MOD_RES (1)..(1): Any amino acid
XAPLPALRLLDLRWIEDVKDSQLRELLLPPPDTKPAERPGPEPLRPRRGPQCSPPHGPHVPTPRDPGAPQSCWLPPPNGPLPPAVPPLPSSTPPRPALLPPALTRSLCPAGSCRAPWPLPLP

SEQ ID NO: 31004 - protein, 382 aa, Homo sapiens
  Payload ID: 6080
  Gene Symbol: FBXL19
  Gene Name: F-box and leucine-rich repeat protein 19
  ENSP ID: ENSP00000458033
MCQLLERVPDTSSSSSDSDSDSDSSGTSLSEDEAPGEARNGRRPARGSSGEKENRGGRRAVRPGSGGPLLSWPLGPAPPPRPPQLERHVVRPPPRSPEPDTLPLAAGSDHPLPRAAWLRVFQHLGPRELCICMRVCRTWSRWCYDKRLWPRMDLSRRKSLTPPMLSGVVRRQPRALDLSWTGVSKKQLMWLLNRLQGLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGCHRLTDHCLPLFRRCPRLRRLDLRSCRQLSPEACARLAAAGPPGPFRCPEEKLLLKDS

SEQ ID NO: 31005 - protein, 80 aa, Homo sapiens
  Payload ID: 6081
  Gene Symbol: FBXL2
  Gene Name: F-box and leucine-rich repeat protein 2
  ENSP ID: ENSP00000405084
MVFSNNDEGLINKKLPKELLLRMLFSLLLNFTWSNPECTKYVHSIGLDSFCNVHSMGFLKDCCLYFLLSVVPAALYTRAS

SEQ ID NO: 31006 - protein, 36 aa, Homo sapiens
  Payload ID: 6081
  Gene Symbol: FBXL2
  Gene Name: F-box and leucine-rich repeat protein 2
  ENSP ID: ENSP00000406737
MVFSNNDEGLINKKLPKELLLRVEWWKISRSDAVDS

SEQ ID NO: 31007 - protein, 129 aa, Homo sapiens
  Payload ID: 6081
  Gene Symbol: FBXL2
  Gene Name: F-box and leucine-rich repeat protein 2
  ENSP ID: ENSP00000408895
MVFSNNDEGLINKKLPKELLLRIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSASALFQHVL

SEQ ID NO: 31008 - protein, 62 aa, Homo sapiens
  Payload ID: 6081
  Gene Symbol: FBXL2
  Gene Name: F-box and leucine-rich repeat protein 2
  ENSP ID: ENSP00000411273
MVFSNNDEGLINKKLPKELLLRMLFSLLLNFTWSNPECTKYVHSIGLDSFCNVDLCTELPKH

SEQ ID NO: 31009 - protein, 63 aa, Homo sapiens
  Payload ID: 6081
  Gene Symbol: FBXL2
  Gene Name: F-box and leucine-rich repeat protein 2
  ENSP ID: ENSP00000411484
MVFSNNDEGLINKKLPKELLLRMLFSLLLNFTWSNPECTKYVHSIGLDSFCNVEQGQDNNNKQ

SEQ ID NO: 31010 - protein, 89 aa, Homo sapiens
  Payload ID: 6081
  Gene Symbol: FBXL2
  Gene Name: F-box and leucine-rich repeat protein 2
  ENSP ID: ENSP00000416332
MVFSNNDEGLINKKLPKELLLRMLFSLLLNFTWSNPECTKYVHSIGLDSFCNVNIFLLGYSNFVPMCTDFQGLEHLSPGWKQLAKNRSF

SEQ ID NO: 31011 - protein, 423 aa, Homo sapiens
  Payload ID: 6081
  Gene Symbol: FBXL2
  Gene Name: F-box and leucine-rich repeat protein 2
  Uniprot ID: Q9UKC9
  ENSP ID: ENSP00000417601
MVFSNNDEGLINKKLPKELLLRIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSTCYSLSRFCSKLKHLDLTSCVSITNSSLKGISEGCRNLEYLNLSWCDQITKDGIEALVRGCRGLKALLLRGCTQLEDEALKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 31012 - protein, 355 aa, Homo sapiens
  Payload ID: 6081
  Gene Symbol: FBXL2
  Gene Name: F-box and leucine-rich repeat protein 2
  Uniprot ID: Q9UKC9
  ENSP ID: ENSP00000426163
MVFSNNDEGLINKKLPKELLLRIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSTCYSLSRFCSKLKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 31013 - protein, 355 aa, Homo sapiens; identical to SEQ ID NO: 31012
  Payload ID: 6081
  Gene Symbol: FBXL2
  Gene Name: F-box and leucine-rich repeat protein 2
  Uniprot ID: Q9UKC9
  ENSP ID: ENSP00000441228

SEQ ID NO: 31014 - protein, 436 aa, Homo sapiens
  Payload ID: 6082
  Gene Symbol: FBXL20
  Gene Name: F-box and leucine-rich repeat protein 20
  Uniprot ID: Q96IG2
  ENSP ID: ENSP00000264658
MRRDVNGVTKSRFEMFSNSDEAVINKKLPKELLLRIFSFLDVVTLCRCAQVSRAWNVLALDGSNWQRIDLFDFQRDIEGRVVENISKRCGGFLRKLSLRGCLGVGDNALRTFAQNCRNIEVLNLNGCTKTTDATCTSLSKFCSKLRHLDLASCTSITNMSLKALSEGCPLLEQLNISWCDQVTKDGIQALVRGCGGLKALFLKGCTQLEDEALKYIGAHCPELVTLNLQTCLQITDEGLITICRGCHKLQSLCASGCSNITDAILNALGQNCPRLRILEVARCSQLTDVGFTTLARNCHELEKMDLEECVQITDSTLIQLSIHCPRLQVLSLSHCELITDDGIRHLGNGACAHDQLEVIELDNCPLITDASLEHLKSCHSLERIELYDCQQITRAGIKRLRTHLPNIKVHAYFAPVTPPPSVGGSRQRFCRCCIIL

SEQ ID NO: 31015 - protein, 404 aa, Homo sapiens
  Payload ID: 6082
  Gene Symbol: FBXL20
  Gene Name: F-box and leucine-rich repeat protein 20
  Uniprot ID: Q96IG2
  ENSP ID: ENSP00000377832
MRRDVNGVTKSRFEMFSNSDEAVINKKLPKELLLRIFSFLDVVTLCRCAQVSRAWNVLALDGSNWQRIDLFDFQRDIEGRVVENISKRCGGFLRKLSLRGCLGVGDNALRTFAQNCRNIEVLNLNGCTKTTDAEGCPLLEQLNISWCDQVTKDGIQALVRGCGGLKALFLKGCTQLEDEALKYIGAHCPELVTLNLQTCLQITDEGLITICRGCHKLQSLCASGCSNITDAILNALGQNCPRLRILEVARCSQLTDVGFTTLARNCHELEKMDLEECVQITDSTLIQLSIHCPRLQVLSLSHCELITDDGIRHLGNGACAHDQLEVIELDNCPLITDASLEHLKSCHSLERIELYDCQQITRAGIKRLRTHLPNIKVHAYFAPVTPPPSVGGSRQRFCRCCIIL

SEQ ID NO: 31016 - protein, 436 aa, Homo sapiens; identical to SEQ ID NO: 31014
  Payload ID: 6082
  Gene Symbol: FBXL20
  Gene Name: F-box and leucine-rich repeat protein 20
  Uniprot ID: Q96IG2
  ENSP ID: ENSP00000462271

SEQ ID NO: 31017 - protein, 438 aa, Homo sapiens
  Payload ID: 6082
  Gene Symbol: FBXL20
  Gene Name: F-box and leucine-rich repeat protein 20
  ENSP ID: ENSP00000462878
MAPSRDRLLHFGFKATMFSNSDEAVINKKLPKELLLRIFSFLDVVTLCRCAQVSRAWNVLALDGSNWQRIDLFDFQRDIEGRVVENISKRCGGFLRKLSLRGCLGVGDNALRTFAQNCRNIEVLNLNGCTKTTDATCTSLSKFCSKLRHLDLASCTSITNMSLKALSEGCPLLEQLNISWCDQVTKDGIQALVRGCGGLKALFLKGCTQLEDEALKYIGAHCPELVTLNLQTCLQITDEGLITICRGCHKLQSLCASGCSNITDAILNALGQNCPRLRILEVARCSQLTDVGFTTLARNCHELEKMDLEECVQITDSTLIQLSIHCPRLQVLSLSHCELITDDGIRHLGNGACAHDQLEVIELDNCPLITDASLEHLKSCHSLERIELYDCQQITRAGIKRLRTHLPNIKVHAYFAPVTPPPSVGGSRQRFCRCCIIL

SEQ ID NO: 31018 - protein, 115 aa, Homo sapiens
  Payload ID: 6082
  Gene Symbol: FBXL20
  Gene Name: F-box and leucine-rich repeat protein 20
  ENSP ID: ENSP00000463132
TTLARNCHELEKMDLEECVQITDSTLIQLSIHCPRLQVLSLSHCELITDDGIRHLGNGACAHDQLEVIELDNCPLITDASLEHLKSCHSLERIELYDCQQITRAGIKRLRVKMAT

SEQ ID NO: 31019 - protein, 247 aa, Homo sapiens
  Payload ID: 6083
  Gene Symbol: FBXL22
  Gene Name: F-box and leucine-rich repeat protein 22
  Uniprot ID: Q6P050
  ENSP ID: ENSP00000353794
MWPLLTMHITQLNRECLLHLFSFLDKDSRKSLARTCSQLHDVFEDPALWSLLHFRSLTELQKDNFLLGPALRSLSICWHSSRVQVCSIEDWLKSAFQRSICSRHESLVNDFLLRVCDRLSAVRSPRRREAPAPSSGTPIAVGPKSPRWGGPDHSEFADLRSGVTGARAAARRGLGSLRAERPSETPPAPGVSWGPPPPGAPVVISVKQEEGKQGRTGRRSHRAAPPCGFARTRVCPPTFPGADAFPQ

SEQ ID NO: 31020 - protein, 130 aa, Homo sapiens
  Payload ID: 6083
  Gene Symbol: FBXL22
  Gene Name: F-box and leucine-rich repeat protein 22
  ENSP ID: ENSP00000453697
MWPLLTMHITQLNRECLLHLFSFLDKDSRKSLARTCSQLHDVFEDPALWSLLHFRSLTELQKDNFLLGPALRSLSICWHSSRVQVCSIEDWLKSAFQRSICSRHESLVNDFLLRVCDRVRGLNDTVAPGT

SEQ ID NO: 31021 - protein, 27 aa, Homo sapiens
  Payload ID: 6083
  Gene Symbol: FBXL22
  Gene Name: F-box and leucine-rich repeat protein 22
  ENSP ID: ENSP00000473666
HESLVNDFLLRVCDRVRGLNDTVAPGT

SEQ ID NO: 31022 - protein, 428 aa, Homo sapiens
  Payload ID: 6084
  Gene Symbol: FBXL3
  Gene Name: F-box and leucine-rich repeat protein 3
  Uniprot ID: Q9UKT7
  ENSP ID: ENSP00000347834
MKRGGRDSDRNSSEEGTAEKSKKLRTTNEHSQTCDWGNLLQDIILQVFKYLPLLDRAHASQVCRNWNQVFHMPDLWRCFEFELNQPATSYLKATHPELIKQIIKRHSNHLQYVSFKVDSSKESAEAACDILSQLVNCSLKTLGLISTARPSFMDLPKSHFISALTVVFVNSKSLSSLKIDDTPVDDPSLKVLVANNSDTLKLLKMSSCPHVSPAGILCVADQCHGLRELALNYHLLSDELLLALSSEKHVRLEHLRIDVVSENPGQTHFHTIQKSSWDAFIRHSPKVNLVMYFFLYEEEFDPFFRYEIPATHLYFGRSVSKDVLGRVGMTCPRLVELVVCANGLRPLDEELIRIAERCKNLSAIGLGECEVSCSAFVEFVKMCGGRLSQLSIMEEVLIPDQKYSLEQIHWEVSKHLGRVWFPDMMPTW

SEQ ID NO: 31023 - protein, 241 aa, Homo sapiens
  Payload ID: 6084
  Gene Symbol: FBXL3
  Gene Name: F-box and leucine-rich repeat protein 3
  ENSP ID: ENSP00000412183
MKRGGRDSDRNSSEEGTAEKSKKLRTTNEHSQTCDWGNLLQDIILQVFKYLPLLDRAHASQVCRNWNQVDSSKESAEAACDILSQLVNCSLKTLGLISTARPSFMDLPKSHFISALTVVFVNSKSLSSLKIDDTPVDDPSLKVLVANNSDTLKLLKMSSCPHVSPAGILCVADQCHGLRELALNYHLLSDELLLALSSEKHVRLEHLRIDVVSENPGQTHFHTIQKSSWDAFIRHSPKVNL

SEQ ID NO: 31024 - protein, 621 aa, Homo sapiens
  Payload ID: 6085
  Gene Symbol: FBXL4
  Gene Name: F-box and leucine-rich repeat protein 4
  Uniprot ID: Q9UKA2
  ENSP ID: ENSP00000229971
MSPVFPMLTVLTMFYYICLRRRARTATRGEMMNTHRAIESNSQTSPLNAEVVQYAKEVVDFSSHYGSENSMSYTMWNLAGVPNVFPSSGDFTQTAVFRTYGTWWDQCPSASLPFKRTPPNFQSQDYVELTFEQQVYPTAVHVLETYHPGAVIRILACSANPYSPNPPAEVRWEILWSERPTKVNASQARQFKPCIKQINFPTNLIRLEVNSSLLEYYTELDAVVLHGVKDKPVLSLKTSLIDMNDIEDDAYAEKDGCGMDSLNKKFSSAVLGEGPNNGYFDKLPYELIQLILNHLTLPDLCRLAQTCKLLSQHCCDPLQYIHLNLQPYWAKLDDTSLEFLQSRCTLVQWLNLSWTGNRGFISVAGFSRFLKVCGSELVRLELSCSHFLNETCLEVISEMCPNLQALNLSSCDKLPPQAFNHIAKLCSLKRLVLYRTKVEQTALLSILNFCSELQHLSLGSCVMIEDYDVIASMIGAKCKKLRTLDLWRCKNITENGIAELASGCPLLEELDLGWCPTLQSSTGCFTRLAHQLPNLQKLFLTANRSVCDTDIDELACNCTRLQQLDILGTRMVSPASLRKLLESCKDLSLLDVSFCSQIDNRAVLELNASFPKVFIKKSFTQ

SEQ ID NO: 31025 - protein, 621 aa, Homo sapiens; identical to SEQ ID NO: 31024
  Payload ID: 6085
  Gene Symbol: FBXL4
  Gene Name: F-box and leucine-rich repeat protein 4
  Uniprot ID: Q9UKA2
  ENSP ID: ENSP00000358247

SEQ ID NO: 31026 - protein, 691 aa, Homo sapiens
  Payload ID: 6086
  Gene Symbol: FBXL5
  Gene Name: F-box and leucine-rich repeat protein 5
  Uniprot ID: Q9UKA1
  ENSP ID: ENSP00000344866
MAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 31027 - protein, 674 aa, Homo sapiens
  Payload ID: 6086
  Gene Symbol: FBXL5
  Gene Name: F-box and leucine-rich repeat protein 5
  Uniprot ID: Q9UKA1
  ENSP ID: ENSP00000408679
MAPFPEEVDVFTAPHWRMKQLVGLYCDKSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 31028 - protein, 125 aa, Homo sapiens
  Payload ID: 6086
  Gene Symbol: FBXL5
  Gene Name: F-box and leucine-rich repeat protein 5
  ENSP ID: ENSP00000421070
MHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEER

SEQ ID NO: 31029 - protein, 95 aa, Homo sapiens
  Payload ID: 6086
  Gene Symbol: FBXL5
  Gene Name: F-box and leucine-rich repeat protein 5
  ENSP ID: ENSP00000422049
MGKRQTFSWLSKTNFSNNNDFRALLQSLYATFKEFKMHEQIENEYIIGLLQQRSQTIYNVHSDNKLSEMLSLFEKGLKNVKNEYEQLNYAKQLKE

SEQ ID NO: 31030 - protein, 78 aa, Homo sapiens
  Payload ID: 6086
  Gene Symbol: FBXL5
  Gene Name: F-box and leucine-rich repeat protein 5
  ENSP ID: ENSP00000423961
MHEQIENEYIIGLLQQRSQTIYNVHSDNKLSEMLSLFEKGLKNVKNEYEQLNYAKQLKERLEAFTRDFLPHMKEEEEV

SEQ ID NO: 31031 - protein, 56 aa, Homo sapiens
  Payload ID: 6086
  Gene Symbol: FBXL5
  Gene Name: F-box and leucine-rich repeat protein 5
  ENSP ID: ENSP00000424423
MHEQIENEYIIGLLQQRSQTIYNVHSDNKLSEMLSLFEKGLKNVKNEYEQLNYAKQ

SEQ ID NO: 31032 - protein, 110 aa, Homo sapiens
  Payload ID: 6086
  Gene Symbol: FBXL5
  Gene Name: F-box and leucine-rich repeat protein 5
  ENSP ID: ENSP00000425027
MAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKPTTVDWKPYQ

SEQ ID NO: 31033 - protein, 612 aa, Homo sapiens
  Payload ID: 6086
  Gene Symbol: FBXL5
  Gene Name: F-box and leucine-rich repeat protein 5
  ENSP ID: ENSP00000425472
  MOD_RES (1)..(1): Any amino acid
XATFKEFKMHEQIENEYIIGLLQQRSQTIYNVHSDNKLSEMLSLFEKGLKNVKVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 31034 - protein, 129 aa, Homo sapiens
  Payload ID: 6086
  Gene Symbol: FBXL5
  Gene Name: F-box and leucine-rich repeat protein 5
  ENSP ID: ENSP00000425541
MHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFF

SEQ ID NO: 31035 - protein, 183 aa, Homo sapiens
  Payload ID: 6086
  Gene Symbol: FBXL5
  Gene Name: F-box and leucine-rich repeat protein 5
  ENSP ID: ENSP00000426993
DFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEVSEHSTGITHLPPEVMLSIFSYLNPQ

SEQ ID NO: 31036 - protein, 539 aa, Homo sapiens
  Payload ID: 6087
  Gene Symbol: FBXL6
  Gene Name: F-box and leucine-rich repeat protein 6
  Uniprot ID: Q8N531
  ENSP ID: ENSP00000330098
MAAPASRQVRRRARAAPRPRSAEDWWWDRLAPRGSGYHLLQSDSMLLVLSEPGPARPRAQRRASRRTPRQPPRGPSAAAKPKAGLRSEAAAAPAPAPAPTPTPEEGPDAGWGDRIPLEILVQIFGLLVAADGPMPFLGRAARVCRRWQEAASQPALWHTVTLSSPLVGRPAKGGVKAEKKLLASLEWLMPNRFSQLQRLTLIHWKSQVHPVLKLVGECCPRLTFLKLSGCHGVTADALVMLAKACCQLHSLDLQHSMVESTAVVSFLEEAGSRMRKLWLTYSSQTTAILGALLGSCCPQLQVLEVSTGINRNSIPLQLPVEALQKGCPQLQVLRLLNLMWLPKPPGRGVAPGPGFPSLEELCLASSTCNFVSNEVLGRLLHGSPNLRLLDLRGCARITPAGLQDLPCRELEQLHLGLYGTSDRLTLAKEGSPFLTQKWCHTLRELDLSGQGFSEKDLEQALAAFLSTPGGSHPALCSLNLRGTRVTPSTVSSVISGCPGLLYLNLESCRCLPRGLKRAYRGLEEVQWCLEQLLTSPSPS

SEQ ID NO: 31037 - protein, 533 aa, Homo sapiens
  Payload ID: 6087
  Gene Symbol: FBXL6
  Gene Name: F-box and leucine-rich repeat protein 6
  Uniprot ID: Q8N531
  ENSP ID: ENSP00000403873
MAAPASRQVRRRARAAPRPRSAEDWWWDRLAPRGSGYHLLQSDSMLLVLSEPGPARPRAQRRASRRTPRQPPRGPSAAAKPKAGLRSEAAAAPAPAPAPTPTPEEGPDAGWGDRIPLEILVQIFGLLVAADGPMPFLGRAARVCRRWQEAASQPALWHTVTLSSPLVGRPAKGGVKAEKKLLASLEWLMPNRFSQLQRLTLIHWKSQLVGECCPRLTFLKLSGCHGVTADALVMLAKACCQLHSLDLQHSMVESTAVVSFLEEAGSRMRKLWLTYSSQTTAILGALLGSCCPQLQVLEVSTGINRNSIPLQLPVEALQKGCPQLQVLRLLNLMWLPKPPGRGVAPGPGFPSLEELCLASSTCNFVSNEVLGRLLHGSPNLRLLDLRGCARITPAGLQDLPCRELEQLHLGLYGTSDRLTLAKEGSPFLTQKWCHTLRELDLSGQGFSEKDLEQALAAFLSTPGGSHPALCSLNLRGTRVTPSTVSSVISGCPGLLYLNLESCRCLPRGLKRAYRGLEEVQWCLEQLLTSPSPS

SEQ ID NO: 31038 - protein, 449 aa, Homo sapiens
  Payload ID: 6088
  Gene Symbol: FBXL7
  Gene Name: F-box and leucine-rich repeat protein 7
  ENSP ID: ENSP00000329632
DSDLSMRTLSTPSPALICPPNLPGFQNGRGSSTSSSSITGETVAMVHSPPPTRLTHPLIRLASRPQKEQASIDRLPDHSMVQIFSFLPTNQLCRCARVCRRWYNLAWDPRLWRTIRLTGETINVDRALKVLTRRLCQDTPNVCLMLETVTVSGCRRLTDRGLYTIAQCCPELRRLEVSGCYNISNEAVFDVVSLCPNLEHLDVSGCSKVTCISLTREASIKLSPLHGKQISIRYLDMTDCFVLEDEGLHTIAAHCTQLTHLYLRRCVRLTDEGLRYLVIYCASIKELSVSDCRFVSDFGLREIAKLESRLRYLSIAHCGRVTDVGIRYVAKYCSKLRYLNARGCEGITDHGVEYLAKNCTKLKSLDIGKCPLVSDTGLECLALNCFNLKRLSLKSCESITGQGLQIVAANCFDLQTLNVQDCEVSVEALRFVKRHCKRCVIEHTNPAFF

SEQ ID NO: 31039 - protein, 491 aa, Homo sapiens
  Payload ID: 6088
  Gene Symbol: FBXL7
  Gene Name: F-box and leucine-rich repeat protein 7
  Uniprot ID: Q9UJT9
  ENSP ID: ENSP00000423630
MGANNGKQYGSEGKGSSSISSDVSSSTDHTPTKAQKNVATSEDSDLSMRTLSTPSPALICPPNLPGFQNGRGSSTSSSSITGETVAMVHSPPPTRLTHPLIRLASRPQKEQASIDRLPDHSMVQIFSFLPTNQLCRCARVCRRWYNLAWDPRLWRTIRLTGETINVDRALKVLTRRLCQDTPNVCLMLETVTVSGCRRLTDRGLYTIAQCCPELRRLEVSGCYNISNEAVFDVVSLCPNLEHLDVSGCSKVTCISLTREASIKLSPLHGKQISIRYLDMTDCFVLEDEGLHTIAAHCTQLTHLYLRRCVRLTDEGLRYLVIYCASIKELSVSDCRFVSDFGLREIAKLESRLRYLSIAHCGRVTDVGIRYVAKYCSKLRYLNARGCEGITDHGVEYLAKNCTKLKSLDIGKCPLVSDTGLECLALNCFNLKRLSLKSCESITGQGLQIVAANCFDLQTLNVQDCEVSVEALRFVKRHCKRCVIEHTNPAFF

SEQ ID NO: 31040 - protein, 444 aa, Homo sapiens
  Payload ID: 6088
  Gene Symbol: FBXL7
  Gene Name: F-box and leucine-rich repeat protein 7
  Uniprot ID: Q9UJT9
  ENSP ID: ENSP00000425184
MRTLSTPSPALICPPNLPGFQNGRGSSTSSSSITGETVAMVHSPPPTRLTHPLIRLASRPQKEQASIDRLPDHSMVQIFSFLPTNQLCRCARVCRRWYNLAWDPRLWRTIRLTGETINVDRALKVLTRRLCQDTPNVCLMLETVTVSGCRRLTDRGLYTIAQCCPELRRLEVSGCYNISNEAVFDVVSLCPNLEHLDVSGCSKVTCISLTREASIKLSPLHGKQISIRYLDMTDCFVLEDEGLHTIAAHCTQLTHLYLRRCVRLTDEGLRYLVIYCASIKELSVSDCRFVSDFGLREIAKLESRLRYLSIAHCGRVTDVGIRYVAKYCSKLRYLNARGCEGITDHGVEYLAKNCTKLKSLDIGKCPLVSDTGLECLALNCFNLKRLSLKSCESITGQGLQIVAANCFDLQTLNVQDCEVSVEALRFVKRHCKRCVIEHTNPAFF

SEQ ID NO: 31041 - protein, 374 aa, Homo sapiens
  Payload ID: 6089
  Gene Symbol: FBXL8
  Gene Name: F-box and leucine-rich repeat protein 8
  Uniprot ID: Q96CD0
  ENSP ID: ENSP00000258200
MAEPGEGLPEEVLALIFRHLSLRDRAAAARVCRAWAAAATCSAVWHDTKISCECELEGMLPPYLSACLDHIHNLRLEFEPSRKPSRRAAIELLMVLAGRAPGLRGLRLECRGEKPLFDAGRDVLEAVHAVCGAASQLRHLDLRRLSFTLDDALVLQAARSCPELHSLFLDNSTLVGSVGPGSVLELLEACPRLRALGLHLASLSHAILEALAAPDRAPFALLALRCACPEDARASPLPNEAWVALRRRHPGLAVELELEPALPAESVTRVLQPAVPVAALRLNLSGDTVGPVRFAAHHYAATLCALEVRAAASAELNAALEELAARCAALREVHCFCVVSHSVLDAFRAHCPRLRTYTLKLTREPHPWRPTLVA

SEQ ID NO: 31042 - protein, 62 aa, Homo sapiens
  Payload ID: 6089
  Gene Symbol: FBXL8
  Gene Name: F-box and leucine-rich repeat protein 8
  ENSP ID: ENSP00000427895
MAEPGEGLPEEVLALIFRHLSLRDRAAAARVCRAWAAAATCSAVWHDTKIRFHPVADATEIF

SEQ ID NO: 31043 - protein, 128 aa, Homo sapiens
  Payload ID: 6089
  Gene Symbol: FBXL8
  Gene Name: F-box and leucine-rich repeat protein 8
  ENSP ID: ENSP00000428379
MAEPGEGLPEEVLALIFRHLSLRDRAAAARVCRAWAAAATCSAVWHDTKISCECELEGMLPPYLSACLDHIHNLRLEFEPSRKPSRRAAIELLMVLAGRAPGLRGLRLECRGEKPLFDAGRDVLEAVH

SEQ ID NO: 31044 - protein, 67 aa, Homo sapiens
  Payload ID: 6089
  Gene Symbol: FBXL8
  Gene Name: F-box and leucine-rich repeat protein 8
  ENSP ID: ENSP00000429684
MAEPGEGLPEEVLALIFRHLSLRDRAAAARVCRAWAAAATCSAVWHDTKISQPSPWLRCASTSQATP

SEQ ID NO: 31045 - protein, 163 aa, Homo sapiens
  Payload ID: 6089
  Gene Symbol: FBXL8
  Gene Name: F-box and leucine-rich repeat protein 8
  ENSP ID: ENSP00000430027
MAEPGEGLPEEVLALIFRHLSLRDRAAAARVCRAWAAAATCSAVWHDTKISCECELEGMLPPYLSACLDHIHNLRLEFEPSRKPSRRAAIELLMVLAGRAPGLRGLRLECRGEKPLFDAGRDVLEAVHAVCGAASQLRHLDLRRLSFTLDDALVLQAARSCPE

SEQ ID NO: 31046 - protein, 374 aa, Homo sapiens; identical to SEQ ID NO: 31041
  Payload ID: 6089
  Gene Symbol: FBXL8
  Gene Name: F-box and leucine-rich repeat protein 8
  Uniprot ID: Q96CD0
  ENSP ID: ENSP00000430490

SEQ ID NO: 31047 - protein, 136 aa, Homo sapiens
  Payload ID: 6089
  Gene Symbol: FBXL8
  Gene Name: F-box and leucine-rich repeat protein 8
  ENSP ID: ENSP00000430745
MAEPGEGLPEEVLALIFRHLSLRDRAAAARVCRAWAAAATCSAVWHDTKIRRPTRSVLDTLPPSLASTPLRTLQLRGPGAGRGRARARAGPQGTCPAHTRSRTGDFSCRTKKEIEGPRGVGLEPKSPTHLTPPHPT

SEQ ID NO: 31048 - protein, 51 aa, Homo sapiens
  Payload ID: 6089
  Gene Symbol: FBXL8
  Gene Name: F-box and leucine-rich repeat protein 8
  ENSP ID: ENSP00000464169
MAEPGEGLPEEVLALIFRHLSLRDRAAAARVCRAWAAAATCSAVWHDTKIR

SEQ ID NO: 31049 - protein, 999 aa, Homo sapiens
  Payload ID: 6090
  Gene Symbol: FBXW10
  Gene Name: F-box and WD repeat domain containing 10
  Uniprot ID: Q5XX13
  ENSP ID: ENSP00000306937
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHLLGAASNPEEPWRNSLRCISEMNRLFSGKGDITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLIEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKMVVNTESNVLMFQFEHIKWQYAVEKTKQKKNKEKEEEKEENSLMEILSKCNIQVHSPRESVSSKQTVIQELLPGKPPKSRVLLKPAKFSSAVLIEELQSQGKSKSPRRDADDVEKAQKQGQLETPGKLPSHPKKKSWKIPMSPDQFLLTVSALQHAHNSGEFAYPCRPQTEITDVWGPSISYPRKVLNFKGKSIQRAVDRLRLSNPPIDVKRTSIPLEIQKLQPNLKISLHSPRVQSTIPQPMIIRSRFSGSLKGGDQVTSSIERAVCSTGPLTSMQVIKPNRMLAPQVGTATLSLKKERPRIYTALDPFRVNTEFVLLTVKEEKEHQEAKMKEYQARESTGVVDPGKVSKAAWIRKIKGLPIDNFTKQGKTAAPELGQNVFI

SEQ ID NO: 31050 - protein, 1061 aa, Homo sapiens
  Payload ID: 6090
  Gene Symbol: FBXW10
  Gene Name: F-box and WD repeat domain containing 10
  Uniprot ID: Q5XX13
  ENSP ID: ENSP00000310382
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHLLGAASNPEEPWRNSLRCISEMNRLFSGKGDITKPGYDPCNLLVDLDDIRDLSSGFSKYRDFIRYLPIHLSKYILSMLGCMRGFPRHLPSWPSSGVSGSIFFFPGMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLIEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFLNGNCMKVLKANGRGDPVLSFFIQGNRMVVNTESNVLMFQFEHIKWQYAVEKTKQKKNKEKEEEKEENSLMEILSKCNIQVHSPRESVSSKQTVIQELLPGKPPKSRVLLKPAKFSSDDVEKAQKQGQLETPGKLPSHPKKKSWKIPMSPDQFLLTVSALQHAHNSGEFAYPCRPQTEITDVWGPSISYPRKVLNFKGKSIQRAVDRLRLSNPPIDVKRTSIPLEIQKLQPNLKISLHSPRVQSTIPQPMIIRSRFSGSLKGGDQVTSSIERAVCSTGPLTSMQVIKPNRMLAPQVGTATLSLKKERPRIYTALDPFRVNTEFVLLTVKEEKEHQEAKMKEYQARESTGVVDPGKVSKAAWIRKIKGLPIDNFTKQGKTAAPELGQNVFI

SEQ ID NO: 31051 - protein, 1052 aa, Homo sapiens
  Payload ID: 6090
  Gene Symbol: FBXW10
  Gene Name: F-box and WD repeat domain containing 10
  Uniprot ID: Q5XX13
  ENSP ID: ENSP00000379025
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHLLGAASNPEEPWRNSLRCISEMNRLFSGKGDITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLIEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFLNGNCMKVLKANGRGDPVLSFFIQGNRMVVNTESNVLMFQFEHIKWQYAVEKTKQKKNKEKEEEKEENSLMEILSKCNIQVHSPRESVSSKQTVIQELLPGKPPKSRVLLKPAKFSSAVLIEELQSQGKSKSPRRDADDVEKAQKQGQLETPGKLPSHPKKKSWKIPMSPDQFLLTVSALQHAHNSGEFAYPCRPQTEITDVWGPSISYPRKVLNFKGKSIQRAVDRLRLSNPPIDVKRTSIPLEIQKLQPNLKISLHSPRVQSTIPQPMIIRSRFSGSLKGGDQVTSSIERAVCSTGPLTSMQVIKPNRMLAPQVGTATLSLKKERPRIYTALDPFRVNTEFVLLTVKEEKEHQEAKMKEYQARESTGVVDPGKVSKAAWIRKIKGLPIDNFTKQGKTAAPELGQNVFI

SEQ ID NO: 31052 - protein, 196 aa, Homo sapiens
  Payload ID: 6090
  Gene Symbol: FBXW10
  Gene Name: F-box and WD repeat domain containing 10
  ENSP ID: ENSP00000463552
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGKQGHRQRLEGPRRPEGKASEICKELQL

SEQ ID NO: 31053 - protein, 542 aa, Homo sapiens
  Payload ID: 6091
  Gene Symbol: FBXW11
  Gene Name: F-box and WD repeat domain containing 11
  Uniprot ID: Q9UKB1
  ENSP ID: ENSP00000265094
MEPDSVIEDKTIELMCSVPRSLWLGCANLVESMCALSCLQSMPSVRCLQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 31054 - protein, 529 aa, Homo sapiens
  Payload ID: 6091
  Gene Symbol: FBXW11
  Gene Name: F-box and WD repeat domain containing 11
  Uniprot ID: Q9UKB1
  ENSP ID: ENSP00000296933
MEPDSVIEDKTIELMNTSVMEDQNEDESPKKNTLWQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 31055 - protein, 508 aa, Homo sapiens
  Payload ID: 6091
  Gene Symbol: FBXW11
  Gene Name: F-box and WD repeat domain containing 11
  Uniprot ID: Q9UKB1
  ENSP ID: ENSP00000377391
MEPDSVIEDKTIELMISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 31056 - protein, 47 aa, Homo sapiens
  Payload ID: 6091
  Gene Symbol: FBXW11
  Gene Name: F-box and WD repeat domain containing 11
  ENSP ID: ENSP00000427777
MEPDSVIEDKTIELMLPKCMFGILLKKAGYSKRKESWKMLDCCLFSD

SEQ ID NO: 31057 - protein, 196 aa, Homo sapiens
  Payload ID: 6091
  Gene Symbol: FBXW11
  Gene Name: F-box and WD repeat domain containing 11
  ENSP ID: ENSP00000428753
MEPDSVIEDKTIELMCSVPRSLWLGCANLVESMCALSCLQSMPSVRCLQNTSVMEDQNEDESPKKNTLWQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTD

SEQ ID NO: 31058 - protein, 74 aa, Homo sapiens
  Payload ID: 6091
  Gene Symbol: FBXW11
  Gene Name: F-box and WD repeat domain containing 11
  ENSP ID: ENSP00000429818
MIMRPPHPCGTNTSVMEDQNEDESPKKNTLWQISNGTSSVIVSRKRPSEGNYQKEKDLCIKYFDQWSESDQVEF

SEQ ID NO: 31059 - protein, 47 aa, Homo sapiens; identical to SEQ ID NO: 31056
  Payload ID: 6091
  Gene Symbol: FBXW11
  Gene Name: F-box and WD repeat domain containing 11
  ENSP ID: ENSP00000430104

SEQ ID NO: 31060 - protein, 47 aa, Homo sapiens; identical to SEQ ID NO: 31056
  Payload ID: 6091
  Gene Symbol: FBXW11
  Gene Name: F-box and WD repeat domain containing 11
  ENSP ID: ENSP00000431100

SEQ ID NO: 31061 - protein, 464 aa, Homo sapiens
  Payload ID: 6092
  Gene Symbol: FBXW12
  Gene Name: F-box and WD repeat domain containing 12
  Uniprot ID: Q6X9E4
  ENSP ID: ENSP00000296438
MEIRLPDLALKRIFSFLDLFGLLQVSQVNKHWNRIADSDYLWRSLSLQRWDCSNFTNQHLGTHTWKQFFLHQRRKELRLALAQPHNFIYKVTKNIAFETELAYLSGNRLTVDEQEKSIICSVSPKQELCAWDVQEGTMIWSSPVQEFHFSNLVTLPQMHLAITMDRKKTIKVWNCQDRDALAVLPMPQPCYCMEAYLTKDGPFLMVGDAAGDIYTFTLPGLRDVSKVTAFQYGIVLLHCSPDKKWVFACGTYSRTLPQVFLTESLLRPSEGSVPLSTFLPHKLCASACWTPKVKNRITLMSQSSTGKKTEFITFDLTTKKTGGQTVIQAYEIASFQVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDSCISSVMCDNASIVLRVRKVSDSSILVMYSLNT

SEQ ID NO: 31062 - protein, 445 aa, Homo sapiens
  Payload ID: 6092
  Gene Symbol: FBXW12
  Gene Name: F-box and WD repeat domain containing 12
  Uniprot ID: Q6X9E4
  ENSP ID: ENSP00000406139
MSPTHQIQDPKHWNRIADSDYLWRSLSLQRWDCSNFTNQHLGTHTWKQFFLHQRRKELRLALAQPHNFIYKVTKNIAFETELAYLSGNRLTVDEQEKSIICSVSPKQELCAWDVQEGTMIWSSPVQEFHFSNLVTLPQMHLAITMDRKKTIKVWNCQDRDALAVLPMPQPCYCMEAYLTKDGPFLMVGDAAGDIYTFTLPGLRDVSKVTAFQYGIVLLHCSPDKKWVFACGTYSRTLPQVFLTESLLRPSEGSVPLSTFLPHKLCASACWTPKVKNRITLMSQSSTGKKTEFITFDLTTKKTGGQTVIQAYEIASFQVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDSCISSVMCDNASIVLRVRKVSDSSILVMYSLNT

SEQ ID NO: 31063 - protein, 307 aa, Homo sapiens
  Payload ID: 6092
  Gene Symbol: FBXW12
  Gene Name: F-box and WD repeat domain containing 12
  ENSP ID: ENSP00000413866
MHLAITMDRKKTIKVWNCQDRDALAVLPMPQPCYCMEAYLTKDGPFLMVGDAAGDIYTFTLPGLRDVSKVTAFQYGIVLLHCSPDKKWVFACGTYSRTLPQVFLTESLLRPSEGSVPLSTFLPHKLCASACWTPKVKNRITLMSQSSTGKKTEFITFDLTTKKTGGQTVIQAYEIASFQVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDSCISSVMCDNASIVLRVRKVSDSSILVMYSLNT

SEQ ID NO: 31064 - protein, 394 aa, Homo sapiens
  Payload ID: 6092
  Gene Symbol: FBXW12
  Gene Name: F-box and WD repeat domain containing 12
  Uniprot ID: Q6X9E4
  ENSP ID: ENSP00000414683
MEIRLPDLALKRIFSFLDLFGLLQVSQVNKHWNRIADSDYLWRSLSLQRWDCSNFTNQHLGTHTWKQFFLHQRRKELRLALAQPHNFIYKVTKNIAFETELAYLSGNRLTVDEQEKSIICSVSPKQELCAWDVQEVGDAAGDIYTFTLPGLRDVSKVTAFQYGIVLLHCSPDKKWVFACGTYSRTLPQVFLTESLLRPSEGSVPLSTFLPHKLCASACWTPKVKNRITLMSQSSTGKKTEFITFDLTTKKTGGQTVIQAYEIASFQVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDSCISSVMCDNASIVLRVRKVSDSSILVMYSLNT

SEQ ID NO: 31065 - protein, 208 aa, Homo sapiens
  Payload ID: 6093
  Gene Symbol: FBXW2
  Gene Name: F-box and WD repeat domain containing 2
  ENSP ID: ENSP00000398662
MKQLEDHEAFETSSLIGHSARVYALYYKDGLLCTGSDDLSAKLWDVSTGQCVYGIQTHTCAAVKFDEQKLVTGSFDNTVACWEWSSGARTQHFRGHTGAVFSVDYNDELDILVSGSADFTVKVWALSAGTCLNTLTGHTEWVTKVVLQKCKVKSLLHSPGDYILLSADKYEIKIWPIGREINCKCLKTLSVSEDRSICLQPRLHFDGK

SEQ ID NO: 31066 - protein, 454 aa, Homo sapiens
  Payload ID: 6093
  Gene Symbol: FBXW2
  Gene Name: F-box and WD repeat domain containing 2
  Uniprot ID: Q9UKT8
  ENSP ID: ENSP00000476369
MERKDFETWLDNISVTFLSLTDLQKNETLDHLISLSGAVQLRHLSNNLETLLKRDFLKLLPLELSFYLLKWLDPQTLLTCCLVSKQWNKVISACTEVWQTACKNLGWQIDDSVQDALHWKKVYLKAILRMKQLEDHEAFETSSLIGHSARVYALYYKDGLLCTGSDDLSAKLWDVSTGQCVYGIQTHTCAAVKFDEQKLVTGSFDNTVACWEWSSGARTQHFRGHTGAVFSVDYNDELDILVSGSADFTVKVWALSAGTCLNTLTGHTEWVTKVVLQKCKVKSLLHSPGDYILLSADKYEIKIWPIGREINCKCLKTLSVSEDRSICLQPRLHFDGKYIVCSSALGLYQWDFASYDILRVIKTPEIANLALLGFGDIFALLFDNRYLYIMDLRTESLISRWPLPEYRKSKRGSSFLAGEASWLNGLDGHNDTGLVFATSMPDHSIHLVLWKEHG

SEQ ID NO: 31067 - protein, 412 aa, Homo sapiens
  Payload ID: 6094
  Gene Symbol: FBXW4
  Gene Name: F-box and WD repeat domain containing 4
  Uniprot ID: P57775
  ENSP ID: ENSP00000359149
MAAAAGEEEEEEEAARESAARPAAGPALWRLPEELLLLICSYLDMRALGRLAQVCRWLRRFTSCDLLWRRIARASLNSGFTRLGTDLMTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 31068 - protein, 566 aa, Homo sapiens
  Payload ID: 6095
  Gene Symbol: FBXW5
  Gene Name: F-box and WD repeat domain containing 5
  Uniprot ID: Q969U6
  ENSP ID: ENSP00000313034
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 31069 - protein, 129 aa, Homo sapiens
  Payload ID: 6095
  Gene Symbol: FBXW5
  Gene Name: F-box and WD repeat domain containing 5
  ENSP ID: ENSP00000394011
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLH

SEQ ID NO: 31070 - protein, 200 aa, Homo sapiens
  Payload ID: 6095
  Gene Symbol: FBXW5
  Gene Name: F-box and WD repeat domain containing 5
  ENSP ID: ENSP00000404829
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKAITTAAPAEQIWSNDLTISLLHSADMRPYNWSYTQFSQFNKDDSLLLASGVFLGPHNSSSGEIAVISLDSFALLSRVRNKPYD

SEQ ID NO: 31071 - protein, 193 aa, Homo sapiens
  Payload ID: 6095
  Gene Symbol: FBXW5
  Gene Name: F-box and WD repeat domain containing 5
  ENSP ID: ENSP00000485109
  MOD_RES (1)..(1): Any amino acid
XNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGTPLPPCCPPRS

SEQ ID NO: 31072 - protein, 117 aa, Homo sapiens
  Payload ID: 6095
  Gene Symbol: FBXW5
  Gene Name: F-box and WD repeat domain containing 5
  ENSP ID: ENSP00000485322
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVK

SEQ ID NO: 31073 - protein, 627 aa, Homo sapiens
  Payload ID: 6096
  Gene Symbol: FBXW7
  Gene Name: F-box and WD repeat domain containing 7, E3 ubiquitin protein ligase
  Uniprot ID: Q969H0
  ENSP ID: ENSP00000263981
MCVPRSGLILSCICLYCGVLLPVLLPNLPFLTCLSMSTLESVTYLPEKGLYCQRLPSSRTHGGTESLKGKNTENMGFYGTLKMIFYKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 31074 - protein, 707 aa, Homo sapiens
  Payload ID: 6096
  Gene Symbol: FBXW7
  Gene Name: F-box and WD repeat domain containing 7, E3 ubiquitin protein ligase
  Uniprot ID: Q969H0
  ENSP ID: ENSP00000281708
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 31075 - protein, 589 aa, Homo sapiens
  Payload ID: 6096
  Gene Symbol: FBXW7
  Gene Name: F-box and WD repeat domain containing 7, E3 ubiquitin protein ligase
  Uniprot ID: Q969H0
  ENSP ID: ENSP00000296555
MSKPGKPTLNHGLVPVDLKSAKEPLPHQTVMKIFSISIIAQGLPFCRRRMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 31076 - protein, 531 aa, Homo sapiens
  Payload ID: 6096
  Gene Symbol: FBXW7
  Gene Name: F-box and WD repeat domain containing 7, E3 ubiquitin protein ligase
  ENSP ID: ENSP00000377528
MLFFKCISLLLIWLIPGQSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 31077 - protein, 158 aa, Homo sapiens
  Payload ID: 6096
  Gene Symbol: FBXW7
  Gene Name: F-box and WD repeat domain containing 7, E3 ubiquitin protein ligase
  ENSP ID: ENSP00000474538
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLS

SEQ ID NO: 31078 - protein, 707 aa, Homo sapiens; identical to SEQ ID NO: 31074
  Payload ID: 6096
  Gene Symbol: FBXW7
  Gene Name: F-box and WD repeat domain containing 7, E3 ubiquitin protein ligase
  Uniprot ID: Q969H0
  ENSP ID: ENSP00000474725

SEQ ID NO: 31079 - protein, 176 aa, Homo sapiens
  Payload ID: 6096
  Gene Symbol: FBXW7
  Gene Name: F-box and WD repeat domain containing 7, E3 ubiquitin protein ligase
  ENSP ID: ENSP00000474751
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKVSIFNILLT

SEQ ID NO: 31080 - protein, 707 aa, Homo sapiens; identical to SEQ ID NO: 31074
  Payload ID: 6096
  Gene Symbol: FBXW7
  Gene Name: F-box and WD repeat domain containing 7, E3 ubiquitin protein ligase
  Uniprot ID: Q969H0
  ENSP ID: ENSP00000474971

SEQ ID NO: 31081 - protein, 598 aa, Homo sapiens
  Payload ID: 6097
  Gene Symbol: FBXW8
  Gene Name: F-box and WD repeat domain containing 8
  Uniprot ID: Q8N3Y1
  ENSP ID: ENSP00000310686
MDDYSLDEFRRRWQEELAQAQAPKKRRRPEAAERRARRPEVGSGRGEQASGDPALAQRLLEGAGRPPAARATRAEGQDVASRSRSPLAREGAGGGEQLVDQLIRDLNEMNDVPFFDIQLPYELAINIFQYLDRKELGRCAQVSKTWKVIAEDEVLWYRLCQQEGHLPDSSISDYSCWKLIFQECRAKEHMLRTNWKNRKGAVSELEHVPDTVLCDVHSHDGVVIAGYTSGDVRVWDTRTWDYVAPFLESEDEEDEPGMQPNVSFVRINSSLAVAAYEDGFLNIWDLRTGKYPVHRFEHDARIQALALSQDDATVATASAFDVVMLSPNEEGYWQIAAEFEVPKLVQYLEIVPETRRYPVAVAAAGDLMYLLKAEDSARTLLYAHGPPVTCLDVSANQVAFGVQGLGWVYEGSKILVYSLEAGRRLLKLGNVLRDFTCVNLSDSPPNLMVSGNMDGRVRIHDLRSGNIALSLSAHQLRVSAVQMDDWKIVSGGEEGLVSVWDYRMNQKLWEVYSGHPVQHISFSSHSLITANVPYQTVMRNADLDSFTTHRRHRGLIRAYEFAVDQLAFQSPLPVCRSSCDAMATHYYDLALAFPYNHV

SEQ ID NO: 31082 - protein, 532 aa, Homo sapiens
  Payload ID: 6097
  Gene Symbol: FBXW8
  Gene Name: F-box and WD repeat domain containing 8
  Uniprot ID: Q8N3Y1
  ENSP ID: ENSP00000389144
MDDYSLDEFRRRWQEELAQAQAPKKRRRPEAAERRARRPENEMNDVPFFDIQLPYELAINIFQYLDRKELGRCAQVSKTWKVIAEDEVLWYRLCQQEGHLPDSSISDYSCWKLIFQECRAKEHMLRTNWKNRKGAVSELEHVPDTVLCDVHSHDGVVIAGYTSGDVRVWDTRTWDYVAPFLESEDEEDEPGMQPNVSFVRINSSLAVAAYEDGFLNIWDLRTGKYPVHRFEHDARIQALALSQDDATVATASAFDVVMLSPNEEGYWQIAAEFEVPKLVQYLEIVPETRRYPVAVAAAGDLMYLLKAEDSARTLLYAHGPPVTCLDVSANQVAFGVQGLGWVYEGSKILVYSLEAGRRLLKLGNVLRDFTCVNLSDSPPNLMVSGNMDGRVRIHDLRSGNIALSLSAHQLRVSAVQMDDWKIVSGGEEGLVSVWDYRMNQKLWEVYSGHPVQHISFSSHSLITANVPYQTVMRNADLDSFTTHRRHRGLIRAYEFAVDQLAFQSPLPVCRSSCDAMATHYYDLALAFPYNHV

SEQ ID NO: 31083 - protein, 458 aa, Homo sapiens
  Payload ID: 6098
  Gene Symbol: FBXW9
  Gene Name: F-box and WD repeat domain containing 9
  Uniprot ID: Q5XUX1
  ENSP ID: ENSP00000376945
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRVRAPYPVVEEKNFDWPAACIALEQHLSRWAEDGRWVEYFCLAEGHVASVDSVLLLQGGSLCLSGSRDRNVNLWDLRQLGTESNQVLIKTLGTKRNSTHEGWVWSLAAQDHRVCSGSWDSTVKLWDMAADGQQFGEIKASSAVLCLSYLPDILVTGTYDKKVTIYDPRAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 31084 - protein, 478 aa, Homo sapiens
  Payload ID: 6098
  Gene Symbol: FBXW9
  Gene Name: F-box and WD repeat domain containing 9
  Uniprot ID: Q5XUX1
  ENSP ID: ENSP00000465387
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRKNFDWPAACIALEQHLSRWAEDGRWVEYFCLAEGHVASVDSVLLLQGGSLCLSGSRDRNVNLWDLRQLGTESNQVLIKTLGTKRNSTHEGWVWSLAAQDHRVCSGSWDSTVKLWDMAADGQQFGEIKASSAVLCLSYLPDILVTGTYDKKVTIYDPRDRMETRDALMGWGGPSRGSDIPPHRPITHEAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 31085 - protein, 172 aa, Homo sapiens
  Payload ID: 6098
  Gene Symbol: FBXW9
  Gene Name: F-box and WD repeat domain containing 9
  ENSP ID: ENSP00000465854
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRVRAPYPVVEGWVTLSVGLPRSQRQLVGPAAAGDGVQPGSDQDLRH

SEQ ID NO: 31086 - protein, 573 aa, Homo sapiens
  Payload ID: 6099
  Gene Symbol: FBXO10
  Gene Name: F-box protein 10
  ENSP ID: ENSP00000276960
MEAGGLPLELWRMILAYLHLPDLGRCSLVCRAWYELILSLDSTRWRQLCLGCTECRHPNWPNQPDVEPESWREAFKQHYLASKTWTKNALDLESSICFSLFRRRRERRTLSVGPGREFDSLGSALAMASLYDRIVLFPGVYEEQGEIILKVPVEIVGQGKLGEVALLASIDQHCSTTRLCNLVFTPAWFSPIMYKTTSGHVQFDNCNFENGHIQVHGPGTCQVKFCTFKNTHIFLHNVPLCVLENCEFVGSENNSVTVEGHPSADKNWAYKYLLGLIKSSPTFLPTEDSDFLMSLDLESRDQAWSPKTCDIVIEGSQSPTSPASSSPKPGSKAGSQEAEVGSDGERVAQTPDSSDGGLSPSGEDEDEDQLMYRLSYQVQGPRPVLGGSFLGPPLPGASIQLPSCLVLNSLQQELQKDKEAMALANSVQGCLIRKCLFRDGKGGVFVCSHGRAKMEGNIFRNLTYAVRCIHNSKIIMLRNDIYRCRASGIFLRLEGGGLIAGNNIYHNAEAGVDIRKKSNPLILCNQIHHGLRSGIVVLGNGKGIIRNNQIFSNKEAGIYILYHGNPVVRKCHP

SEQ ID NO: 31087 - protein, 956 aa, Homo sapiens
  Payload ID: 6099
  Gene Symbol: FBXO10
  Gene Name: F-box protein 10
  Uniprot ID: Q9UK96
  ENSP ID: ENSP00000403802
MEAGGLPLELWRMILAYLHLPDLGRCSLVCRAWYELILSLDSTRWRQLCLGCTECRHPNWPNQPDVEPESWREAFKQHYLASKTWTKNALDLESSICFSLFRRRRERRTLSVGPGREFDSLGSALAMASLYDRIVLFPGVYEEQGEIILKVPVEIVGQGKLGEVALLASIDQHCSTTRLCNLVFTPAWFSPIMYKTTSGHVQFDNCNFENGHIQVHGPGTCQVKFCTFKNTHIFLHNVPLCVLENCEFVGSENNSVTVEGHPSADKNWAYKYLLGLIKSSPTFLPTEDSDFLMSLDLESRDQAWSPKTCDIVIEGSQSPTSPASSSPKPGSKAGSQEAEVGSDGERVAQTPDSSDGGLSPSGEDEDEDQLMYRLSYQVQGPRPVLGGSFLGPPLPGASIQLPSCLVLNSLQQELQKDKEAMALANSVQGCLIRKCLFRDGKGGVFVCSHGRAKMEGNIFRNLTYAVRCIHNSKIIMLRNDIYRCRASGIFLRLEGGGLIAGNNIYHNAEAGVDIRKKSNPLILCNQIHHGLRSGIVVLGNGKGIIRNNQIFSNKEAGIYILYHGNPVVSGNHIFKGRAAGIAVNENGKGLITENVIRENQWGGVDIRRGGIPVLRSNLICFGYSDGVVVGDEGKGLIEGNTIYANKGCGVWMMSSSLPHVTSNHVSYNGLYGVAVFSQKDGSSELPRGHRAQENFSEDGDAILWETELEKEDDPLRRPITIALVESNSINHNGASGLYVQSSEALHVITNVIHANGDRGITVAQSSQPTRVANNSISCNRQSGVKVEAQCKVELRGNGIYDNRGHGIITKGDSTIVIENDIIGNRGSGLQLLPRSDTKVIKNRIHSFRAYGIAVRGRAKALVQENIIFQGKTSKTIFQQISNNRECIMQNNKFLVFKKKSDTWRLVNPPARPHLENSLRRPSAAHNGQKVTAMATRITARVEGGYHSNRSVFCTIL

SEQ ID NO: 31088 - protein, 71 aa, Homo sapiens
  Payload ID: 6099
  Gene Symbol: FBXO10
  Gene Name: F-box protein 10
  ENSP ID: ENSP00000440061
MEAGGLPLELWRMILAYLHLPDLGRCSLVCRAWYELILSLDSTRWRQLCLGCTECRHPNWPNQPDVEPESW

SEQ ID NO: 31089 - protein, 591 aa, Homo sapiens
  Payload ID: 6100
  Gene Symbol: FBXO11
  Gene Name: F-box protein 11
  ENSP ID: ENSP00000323822
MMMCLQIWLQKNQVLVHKIVHTNFVEKLFCRKEQRVPQRTVWRAPQLQLQKTLVIVQNVQECLESQDLSAAPAEQYLQEKLPDEVVLKIFSYLLEQDLCRAACVCKRFSELANDPILWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIR

SEQ ID NO: 31090 - protein, 927 aa, Homo sapiens
  Payload ID: 6100
  Gene Symbol: FBXO11
  Gene Name: F-box protein 11
  Uniprot ID: Q86XK2
  ENSP ID: ENSP00000384823
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPILWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIRTGSNPKIRRNKIWGGQNGGILVYNSGLGCIEDNEIFDNAMAGVWIKTDSNPTLRRNKIHDGRDGGICIFNGGRGLLEENDIFRNAQAGVLISTNSHPILRKNRIFDGFAAGIEITNHATATLEGNQIFNNRFGGLFLASGVNVTMKDNKIMNNQDAIEKAVSRGQCLYKISSYTSYPMHDFYRCHTCNTTDRNAICVNCIKKCHQGHDVEFIRHDRFFCDCGAGTLSNPCTLAGEPTHDTDTLYDSAPPIESNTLQHN

SEQ ID NO: 31091 - protein, 57 aa, Homo sapiens
  Payload ID: 6100
  Gene Symbol: FBXO11
  Gene Name: F-box protein 11
  ENSP ID: ENSP00000385127
MHDFYRCHTCNTTDRNAICVNCIKKCHQGHDVEFIRHDRFFCDCGAGTLSNPCTLAG

SEQ ID NO: 31092 - protein, 843 aa, Homo sapiens
  Payload ID: 6100
  Gene Symbol: FBXO11
  Gene Name: F-box protein 11
  Uniprot ID: Q86XK2
  ENSP ID: ENSP00000385398
MVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPILWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIRTGSNPKIRRNKIWGGQNGGILVYNSGLGCIEDNEIFDNAMAGVWIKTDSNPTLRRNKIHDGRDGGICIFNGGRGLLEENDIFRNAQAGVLISTNSHPILRKNRIFDGFAAGIEITNHATATLEGNQIFNNRFGGLFLASGVNVTMKDNKIMNNQDAIEKAVSRGQCLYKISSYTSYPMHDFYRCHTCNTTDRNAICVNCIKKCHQGHDVEFIRHDRFFCDCGAGTLSNPCTLAGEPTHDTDTLYDSAPPIESNTLQHN

SEQ ID NO: 31093 - protein, 140 aa, Homo sapiens
  Payload ID: 6100
  Gene Symbol: FBXO11
  Gene Name: F-box protein 11
  ENSP ID: ENSP00000392272
MVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPILWKRLYMEVFEYTRPMMHPEPGKFYQINPE

SEQ ID NO: 31094 - protein, 81 aa, Homo sapiens
  Payload ID: 6100
  Gene Symbol: FBXO11
  Gene Name: F-box protein 11
  ENSP ID: ENSP00000402692
MHDFYRCHTCNTTDRNAICVNCIKKCHQGHDVEFIRHDRFFCDCGAGTLSNPCTLAGEPTHDTDTLYDSAPPIESNTLQHN

SEQ ID NO: 31095 - protein, 562 aa, Homo sapiens
  Payload ID: 6100
  Gene Symbol: FBXO11
  Gene Name: F-box protein 11
  ENSP ID: ENSP00000428118
  MOD_RES (1)..(1): Any amino acid
XMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIRTGSNPKIRRNKIWGGQNGGILVYNSGLGCIEDNEIFDNAMAGVWIKTDSNPTLRRNKIHDGRDGGICIFNGGRGIVVNFALVKNPVFHYSSISLMINDIAN

SEQ ID NO: 31096 - protein, 510 aa, Homo sapiens
  Payload ID: 6101
  Gene Symbol: FBXO15
  Gene Name: F-box protein 15
  Uniprot ID: Q8NCQ5
  ENSP ID: ENSP00000393154
MATGRGRILQQHWLGLQTLRGPSRGGGAARGRARAFGCRKGPGVKLSAGSAALRCHAGGGQHWESSFSCCSGFLDGMPSEILLKIFSYLDAVSLLCTGCVSRRFYHLANDNFIWIGIYSTAFSPARSNWKFNSVEKIAMSMSFLSVQDKEAGYWKKEYITKQIASVKAALADILKPVNPYTGLPVKTKEALRIFGLGWAIILKEKGGKEYIMEHVDLSINDTSVTVIWYGKKWPCLASLSTLDLCGMTPVFTDWYKTPTKHRLRWHSLIAKYNLSHLTISTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKRGNIENGHVKLIVIHLKNNREHLPLIGKVGLSWKTDIFDGCIKSCSMMDVTLLDEHGKPFWCFSSPVCLRSPATPSDSSSFLGQTYNVDYVDAEGRVHVELVWIRETEEYLIVNLVLYLSIAKINHWFGTEY

SEQ ID NO: 31097 - protein, 102 aa, Homo sapiens
  Payload ID: 6101
  Gene Symbol: FBXO15
  Gene Name: F-box protein 15
  ENSP ID: ENSP00000462117
  MOD_RES (1)..(1): Any amino acid
XPYELPPHSPFLDDSPEYGLHGYQLHVDLHSGGVFYLCGTFRNLFTKRGNIENGHVKLIVIHLKNNREHLPLIGKVGLSWKTDIFDGCIKFPGVPEIACHTL

SEQ ID NO: 31098 - protein, 15 aa, Homo sapiens
  Payload ID: 6101
  Gene Symbol: FBXO15
  Gene Name: F-box protein 15
  ENSP ID: ENSP00000462143
  MOD_RES (1)..(1): Any amino acid
XSSAFQKHLQREEVK

SEQ ID NO: 31099 - protein, 36 aa, Homo sapiens
  Payload ID: 6101
  Gene Symbol: FBXO15
  Gene Name: F-box protein 15
  ENSP ID: ENSP00000462151
  MOD_RES (1)..(1): Any amino acid
XMPSEILLKIFSYLDAVSLLCTGCVSRRFYHLANDK

SEQ ID NO: 31100 - protein, 55 aa, Homo sapiens
  Payload ID: 6101
  Gene Symbol: FBXO15
  Gene Name: F-box protein 15
  ENSP ID: ENSP00000462361
MATGRGRILQQHWLGLQTLRGPSRGGGAARGRARAFGCRSCSSAFQKHLQREEVK

SEQ ID NO: 31101 - protein, 122 aa, Homo sapiens
  Payload ID: 6101
  Gene Symbol: FBXO15
  Gene Name: F-box protein 15
  ENSP ID: ENSP00000463247
  MOD_RES (1)..(1): Any amino acid
XLRWHSLIAKYNLSHLTISTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKRGEID

SEQ ID NO: 31102 - protein, 78 aa, Homo sapiens
  Payload ID: 6101
  Gene Symbol: FBXO15
  Gene Name: F-box protein 15
  ENSP ID: ENSP00000463378
TGSASRRCAGPAGAVARPGGAPGPLGAGDCRACGWGPLAGSPSLRGPALFTVYFIRPAWRKARGRLQREKAYSESVYF

SEQ ID NO: 31103 - protein, 136 aa, Homo sapiens
  Payload ID: 6101
  Gene Symbol: FBXO15
  Gene Name: F-box protein 15
  ENSP ID: ENSP00000463529
MATGRGRILQQHWLGLQTLRGPSRGGGAARGRARAFGCRMPSEILLKIFSYLDAVSLLCTGCVSRRFYHLANDNFIWIGIYSTAFSPARSNWKFNSVEKIAMSMSFLSVQDKEAGYWKKEYITKQIASVKAALADI

SEQ ID NO: 31104 - protein, 39 aa, Homo sapiens
  Payload ID: 6101
  Gene Symbol: FBXO15
  Gene Name: F-box protein 15
  ENSP ID: ENSP00000464177
MATGRGRILQQHWLGLQTLRGPSRGGGAARGRARAFGCR

SEQ ID NO: 31105 - protein, 316 aa, Homo sapiens
  Payload ID: 6102
  Gene Symbol: FBXO16
  Gene Name: F-box protein 16
  ENSP ID: ENSP00000341416
MMAFAPPKNTDGPKMQTKMSTWTPLNHQLLNDRFDKWTDSQRRRILTGLLERCSLSQQKFCCRKLQEKIPAEALDFTTKLPRVLSLYIFSFLDPRSLCRCAQVCWHWKNLAELDQLWMLKCLRFNWYINFSPTPFEQGIWKKHYIQMVKELHITKPKTPPKDGFVIADVQLVTSNSPEEKQSPLSAFRSSSSLRKKNNSGEKALPPWRSSDKHPTDIIRFNYLDNRDPMETVQQGRRKRNQMTPDFSRQSHDKKNKLQDRTRLRKAQSMMSLSASSPLKVPAHLAWPPPESVGLPDTATTAEILMQHPHRHPGPQA

SEQ ID NO: 31106 - protein, 292 aa, Homo sapiens
  Payload ID: 6102
  Gene Symbol: FBXO16
  Gene Name: F-box protein 16
  Uniprot ID: Q8IX29
  ENSP ID: ENSP00000369604
MMAFAPPKNTDGPKMQTKMSTWTPLNHQLLNDRVFEERRALLGKWFDKWTDSQRRRILTGLLERCSLSQQKFCCRKLQEKIPAEALDFTTKLPRVLSLYIFSFLDPRSLCRCAQVCWHWKNLAELDQLWMLKCLRFNWYINFSPTPFEQGIWKKHYIQMVKELHITKPKTPPKDGFVIADVQLVTSNSPEEKQSPLSAFRSSSSLRKKNNSGEKALPPWRSSDKHPTDIIRFNYLDNRDPMETVQQGRRKRNQMTPDFSRQSHDKKNKLQDRTRLRKAQSMMSRRNPFPLCP

SEQ ID NO: 31107 - protein, 69 aa, Homo sapiens
  Payload ID: 6102
  Gene Symbol: FBXO16
  Gene Name: F-box protein 16
  ENSP ID: ENSP00000428683
MMAFAPPKNTDGPKMQTKMSTWTPLNHQLLNDRVFEERRALLGKWMGCCSGWFQIPGLKRFSCLCLPKC

SEQ ID NO: 31108 - protein, 349 aa, Homo sapiens
  Payload ID: 6102
  Gene Symbol: FBXO16
  Gene Name: F-box protein 16
  ENSP ID: ENSP00000428902
MMAFAPPKNTDGPKMQTKMSTWTPLNHQLLNDRVFEERRALLGKWFDKWTDSQRRRILTGLLERCSLSQQKFCCRKLQEKIPAEALDFTTKLPRVLSLYIFSFLDPRSLCRCAQVCWHWKNLAELDQLWMLKCLRFNWYINFSPTPFEQGIWKKHYIQMVKELHITKPKTPPKDGFVIADVQLVTSNSPEEKQSPLSAFRSSSSLRKKNNSGEKALPPWRSSDKHPTDIIRFNYLDNRDPMETVQQGRRKRNQMTPDFSRQSHDKKNKLQDRTRLRKAQSMVMGRGFSVPFASAGEERQQHGECPVPTPWKAVPPGSPGVGTQCLGGALGCPTLGATARRGRSPAFHHL

SEQ ID NO: 31109 - protein, 184 aa, Homo sapiens
  Payload ID: 6102
  Gene Symbol: FBXO16
  Gene Name: F-box protein 16
  ENSP ID: ENSP00000429390
MMAFAPPKNTDGPKMQTKMSTWTPLNHQLLNDRVFEERRALLGKWFDKWTDSQRRRILTGLLERCSLSQQKFCCRKLQEKIPAEALDFTTKLPRVLSLYIFSFLDPRSLCRCAQTPPKDGFVIADVQLVTSNSPEEKQSPLSAFRSSSSLRKKNNSGEKALPPWRSSDKHPTDIIRFNYLDNRD

SEQ ID NO: 31110 - protein, 280 aa, Homo sapiens
  Payload ID: 6102
  Gene Symbol: FBXO16
  Gene Name: F-box protein 16
  Uniprot ID: Q8IX29
  ENSP ID: ENSP00000429687
MMAFAPPKNTDGPKMQTKMSTWTPLNHQLLNDRFDKWTDSQRRRILTGLLERCSLSQQKFCCRKLQEKIPAEALDFTTKLPRVLSLYIFSFLDPRSLCRCAQVCWHWKNLAELDQLWMLKCLRFNWYINFSPTPFEQGIWKKHYIQMVKELHITKPKTPPKDGFVIADVQLVTSNSPEEKQSPLSAFRSSSSLRKKNNSGEKALPPWRSSDKHPTDIIRFNYLDNRDPMETVQQGRRKRNQMTPDFSRQSHDKKNKLQDRTRLRKAQSMMSRRNPFPLCP

SEQ ID NO: 31111 - protein, 94 aa, Homo sapiens
  Payload ID: 6102
  Gene Symbol: FBXO16
  Gene Name: F-box protein 16
  ENSP ID: ENSP00000431064
  MOD_RES (1)..(1): Any amino acid
XIQMVKELHITKPKTPPKDGFVIADVQLVTSNSPEEKQSPLSAFRSSSSLRKKNNSGEKALPPWRSSDKHPTDIIRFNYLDNRDPMETVQQGCP

SEQ ID NO: 31112 - protein, 278 aa, Homo sapiens
  Payload ID: 6103
  Gene Symbol: FBXO17
  Gene Name: F-box protein 17
  Uniprot ID: Q96EF6
  ENSP ID: ENSP00000292852
MGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVSHVFTNFGKGIRYVSFEQYGRDVSSWVGHYGALVTHSSVRVRIRLS

SEQ ID NO: 31113 - protein, 109 aa, Homo sapiens
  Payload ID: 6103
  Gene Symbol: FBXO17
  Gene Name: F-box protein 17
  ENSP ID: ENSP00000469852
IVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEEEVSPY

SEQ ID NO: 31114 - protein, 177 aa, Homo sapiens
  Payload ID: 6103
  Gene Symbol: FBXO17
  Gene Name: F-box protein 17
  ENSP ID: ENSP00000470101
MGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFETVCPAPCHLSFPDGAPRGSLWTW

SEQ ID NO: 31115 - protein, 278 aa, Homo sapiens; identical to SEQ ID NO: 31112
  Payload ID: 6103
  Gene Symbol: FBXO17
  Gene Name: F-box protein 17
  Uniprot ID: Q96EF6
  ENSP ID: ENSP00000470361

SEQ ID NO: 31116 - protein, 94 aa, Homo sapiens
  Payload ID: 6103
  Gene Symbol: FBXO17
  Gene Name: F-box protein 17
  ENSP ID: ENSP00000470390
  MOD_RES (1)..(1): Any amino acid
XAPSQTCFVTSFEWCSKRQLVDLVMEGVWQELLDSAQIEICVADWWGARENCGCVYQLRVRLLDVYEKEVVKFSASPDPVLQWTERGCRQVGPD

SEQ ID NO: 31117 - protein, 278 aa, Homo sapiens; identical to SEQ ID NO: 31112
  Payload ID: 6103
  Gene Symbol: FBXO17
  Gene Name: F-box protein 17
  ENSP ID: ENSP00000488997

SEQ ID NO: 31118 - protein, 94 aa, Homo sapiens; identical to SEQ ID NO: 31116
  Payload ID: 6103
  Gene Symbol: FBXO17
  Gene Name: F-box protein 17
  ENSP ID: ENSP00000489012
  MOD_RES (1)..(1): Any amino acid

SEQ ID NO: 31119 - protein, 177 aa, Homo sapiens; identical to SEQ ID NO: 31114
  Payload ID: 6103
  Gene Symbol: FBXO17
  Gene Name: F-box protein 17
  ENSP ID: ENSP00000489074

SEQ ID NO: 31120 - protein, 109 aa, Homo sapiens; identical to SEQ ID NO: 31113
  Payload ID: 6103
  Gene Symbol: FBXO17
  Gene Name: F-box protein 17
  ENSP ID: ENSP00000489291

SEQ ID NO: 31121 - protein, 278 aa, Homo sapiens; identical to SEQ ID NO: 31112
  Payload ID: 6103
  Gene Symbol: FBXO17
  Gene Name: F-box protein 17
  ENSP ID: ENSP00000489327

SEQ ID NO: 31122 - protein, 296 aa, Homo sapiens
  Payload ID: 6104
  Gene Symbol: FBXO2
  Gene Name: F-box protein 2
  Uniprot ID: Q9UK22
  ENSP ID: ENSP00000346240
MDGDGDPESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESVKKYFASSFEWCRKAQVIDLQAEGYWEELLDTTQPAIVVKDWYSGRSDAGCLYELTVKLLSEHENVLAEFSSGQVAVPQDSDGGGWMEISHTFTDYGPGVRFVRFEHGGQDSVYWKGWFGARVTNSSVWVEP

SEQ ID NO: 31123 - protein, 120 aa, Homo sapiens
  Payload ID: 6104
  Gene Symbol: FBXO2
  Gene Name: F-box protein 2
  ENSP ID: ENSP00000473649
MDALPPGVTGAVQGAWDTSGTLIKESVGQPEEASPEEQPEEASAEEERPEDQQEEEAAAAAAYLDELPEPLLLRVLAALPAAELVQACRLVCLRWKELVDGAPLWLLKCQQEGLVPEGGV

SEQ ID NO: 31124 - protein, 628 aa, Homo sapiens
  Payload ID: 6105
  Gene Symbol: FBXO21
  Gene Name: F-box protein 21
  Uniprot ID: O94952
  ENSP ID: ENSP00000328187
MAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKSFCLVLKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 31125 - protein, 537 aa, Homo sapiens
  Payload ID: 6105
  Gene Symbol: FBXO21
  Gene Name: F-box protein 21
  ENSP ID: ENSP00000414468
MKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 31126 - protein, 225 aa, Homo sapiens
  Payload ID: 6105
  Gene Symbol: FBXO21
  Gene Name: F-box protein 21
  ENSP ID: ENSP00000446973
IDAFGKGKQLTVKECEYLIGQHVTAALYGVVNVKKVLQRMVGNLLSLGKREGIDQSYQLLRDSLDLYLAMYPDQVQLLLLQARLYFHLGIWPEKSFCLVLKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQGAALARGQ

SEQ ID NO: 31127 - protein, 505 aa, Homo sapiens
  Payload ID: 6105
  Gene Symbol: FBXO21
  Gene Name: F-box protein 21
  ENSP ID: ENSP00000449264
  MOD_RES (1)..(1): Any amino acid
XTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGEGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 31128 - protein, 621 aa, Homo sapiens
  Payload ID: 6105
  Gene Symbol: FBXO21
  Gene Name: F-box protein 21
  Uniprot ID: O94952
  ENSP ID: ENSP00000483508
MAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 31129 - protein, 403 aa, Homo sapiens
  Payload ID: 6106
  Gene Symbol: FBXO22
  Gene Name: F-box protein 22
  Uniprot ID: Q8NEZ5
  ENSP ID: ENSP00000307833
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKNPLDIDASGVVGLSFSGHRIQSATVLLNEDVSDEKTAEAAMQRLKAANIPEHNTIGFMFACVGRGFQYYRAKGNVEADAFRKFFPSVPLFGFFGNGEIGCDRIVTGNFILRKCNEVKDDDLFHSYTTIMALIHLGSSK

SEQ ID NO: 31130 - protein, 276 aa, Homo sapiens
  Payload ID: 6106
  Gene Symbol: FBXO22
  Gene Name: F-box protein 22
  Uniprot ID: Q8NEZ5
  ENSP ID: ENSP00000396442
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKYVLCASDFVCE

SEQ ID NO: 31131 - protein, 93 aa, Homo sapiens
  Payload ID: 6106
  Gene Symbol: FBXO22
  Gene Name: F-box protein 22
  ENSP ID: ENSP00000456198
MEPVGCCGECRGSSVDPRSTFVLSNLAEVVERVLTFLPAKALLRVACVCRLWRECVRRVLRTHRSVTWISAGLAEAGHLEGHCLVRVVAEELE

SEQ ID NO: 31132 - protein, 241 aa, Homo sapiens
  Payload ID: 6106
  Gene Symbol: FBXO22
  Gene Name: F-box protein 22
  ENSP ID: ENSP00000457177
CGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVGLLDNPELRVVLVFGYNCCKVGASNYLQQVVSTFSDMNIILAGGQVDNLSSLTSEKNPLDIDASGVVGLSFSGHRIQSATVLLNEDVSDEKTA

SEQ ID NO: 31133 - protein, 78 aa, Homo sapiens
  Payload ID: 6106
  Gene Symbol: FBXO22
  Gene Name: F-box protein 22
  ENSP ID: ENSP00000457297
AAMQRLKAANIPEHNTIGFMFACVGRGFQYYRAKGNVEADAFRKFFPSVPLFGFFGNGEIGCDRIVTGNFILRKCNEV

SEQ ID NO: 31134 - protein, 46 aa, Homo sapiens
  Payload ID: 6106
  Gene Symbol: FBXO22
  Gene Name: F-box protein 22
  Uniprot ID: Q8NEZ5
  ENSP ID: ENSP00000457531
MEPVGCCGECRGSSVDPRSTFVLSNLAEVVERVLTFLPAKALLRVA

SEQ ID NO: 31135 - protein, 160 aa, Homo sapiens
  Payload ID: 6106
  Gene Symbol: FBXO22
  Gene Name: F-box protein 22
  ENSP ID: ENSP00000457569
MADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSE

SEQ ID NO: 31136 - protein, 153 aa, Homo sapiens
  Payload ID: 6106
  Gene Symbol: FBXO22
  Gene Name: F-box protein 22
  ENSP ID: ENSP00000458022
  MOD_RES (1)..(1): Any amino acid
XECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKSK

SEQ ID NO: 31137 - protein, 580 aa, Homo sapiens
  Payload ID: 6107
  Gene Symbol: FBXO24
  Gene Name: F-box protein 24
  Uniprot ID: O75426
  ENSP ID: ENSP00000241071
MGEKAVPLLRRRRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 31138 - protein, 618 aa, Homo sapiens
  Payload ID: 6107
  Gene Symbol: FBXO24
  Gene Name: F-box protein 24
  Uniprot ID: O75426
  ENSP ID: ENSP00000416558
MVWESQQERGGQGPRRQEGRSREGAIRMVRGSQRRKLQKFTRLCGREEGLRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 31139 - protein, 187 aa, Homo sapiens
  Payload ID: 6107
  Gene Symbol: FBXO24
  Gene Name: F-box protein 24
  ENSP ID: ENSP00000417179
MNAEPLAGRERSSPLQWRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCR

SEQ ID NO: 31140 - protein, 37 aa, Homo sapiens
  Payload ID: 6107
  Gene Symbol: FBXO24
  Gene Name: F-box protein 24
  ENSP ID: ENSP00000418814
MGEKAVPLLRRRRTRRACISRHLEAAADVSARAWPPC

SEQ ID NO: 31141 - protein, 130 aa, Homo sapiens
  Payload ID: 6107
  Gene Symbol: FBXO24
  Gene Name: F-box protein 24
  ENSP ID: ENSP00000419587
MEGRCCRAGEISGEVSTGSPQKREEDVCQCRPECSQVKRSCPSCGSELGVEEKRGKGNPISIQLFPPELVEHIISFLPVRDLVALGQTCRYFHEVCDGEGVWRRICRRLSPRLQDQGSGVRPWKRAAILN

SEQ ID NO: 31142 - protein, 318 aa, Homo sapiens
  Payload ID: 6107
  Gene Symbol: FBXO24
  Gene Name: F-box protein 24
  Uniprot ID: O75426
  ENSP ID: ENSP00000419602
MGEKAVPLLRRRRVKRSCPSCGSELGVEEKRGKGNPISIQLFPPELVEHIISFLPVRDLVALGQTCRYFHEVCDGEGVWRRICRRLSPRLQDQDTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDPILCSWLQPPWPGG

SEQ ID NO: 31143 - protein, 568 aa, Homo sapiens
  Payload ID: 6107
  Gene Symbol: FBXO24
  Gene Name: F-box protein 24
  Uniprot ID: O75426
  ENSP ID: ENSP00000420239
MVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 31144 - protein, 291 aa, Homo sapiens
  Payload ID: 6108
  Gene Symbol: FBXO25
  Gene Name: F-box protein 25
  Uniprot ID: Q8TCJ0
  ENSP ID: ENSP00000276326
MEKYSIMKSMNMHRKKGKRTILEMTQILKRHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 31145 - protein, 291 aa, Homo sapiens; identical to SEQ ID NO: 31144
  Payload ID: 6108
  Gene Symbol: FBXO25
  Gene Name: F-box protein 25
  Uniprot ID: Q8TCJ0
  ENSP ID: ENSP00000341345

SEQ ID NO: 31146 - protein, 358 aa, Homo sapiens
  Payload ID: 6108
  Gene Symbol: FBXO25
  Gene Name: F-box protein 25
  Uniprot ID: Q8TCJ0
  ENSP ID: ENSP00000342077
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 31147 - protein, 367 aa, Homo sapiens
  Payload ID: 6108
  Gene Symbol: FBXO25
  Gene Name: F-box protein 25
  Uniprot ID: Q8TCJ0
  ENSP ID: ENSP00000372274
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDYHLALLFKDSGHPCTAADPDSCFTPVSPQHFIDLFKF

SEQ ID NO: 31148 - protein, 124 aa, Homo sapiens
  Payload ID: 6108
  Gene Symbol: FBXO25
  Gene Name: F-box protein 25
  ENSP ID: ENSP00000428872
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNY

SEQ ID NO: 31149 - protein, 29 aa, Homo sapiens
  Payload ID: 6108
  Gene Symbol: FBXO25
  Gene Name: F-box protein 25
  ENSP ID: ENSP00000430191
DSGHPCTAADPDSCFTPVSPQHFIDLFKF

SEQ ID NO: 31150 - protein, 283 aa, Homo sapiens
  Payload ID: 6109
  Gene Symbol: FBXO27
  Gene Name: F-box protein 27
  Uniprot ID: Q8NI29
  ENSP ID: ENSP00000292853
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQEGLRKWMVQHGGDGWVVEENRTTVPGAPSQTCFVTSFSWCCKKQVLDLEEEGLWPELLDSGRIEICVSDWWGARHDSGCMYRLLVQLLDANQTVLDKFSAVPDPIPQWNNNACLHVTHVFSNIKMGVRFVSFEHRGQDTQFWAGHYGARVTNSSVIVRVRLS

SEQ ID NO: 31151 - protein, 283 aa, Homo sapiens; identical to SEQ ID NO: 31150
  Payload ID: 6109
  Gene Symbol: FBXO27
  Gene Name: F-box protein 27
  Uniprot ID: Q8NI29
  ENSP ID: ENSP00000437662

SEQ ID NO: 31152 - protein, 282 aa, Homo sapiens
  Payload ID: 6109
  Gene Symbol: FBXO27
  Gene Name: F-box protein 27
  ENSP ID: ENSP00000470015
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQGLRKWMVQHGGDGWVVEENRTTVPGAPSQTCFVTSFSWCCKKQVLDLEEEGLWPELLDSGRIEICVSDWWGARHDSGCMYRLLVQLLDANQTVLDKFSAVPDPIPQWNNNACLHVTHVFSNIKMGVRFVSFEHRGQDTQFWAGHYGARVTNSSVIVRVRLS

SEQ ID NO: 31153 - protein, 100 aa, Homo sapiens
  Payload ID: 6109
  Gene Symbol: FBXO27
  Gene Name: F-box protein 27
  ENSP ID: ENSP00000471267
  MOD_RES (1)..(1): Any amino acid
XQLLDANQTVLDKFSAVPDPIPQWNNNACLHRHSFTMLPGLVLNSCAQAILSPQPPTVLGLQAQATASSPCVFLSAPIPALRLTRWNLTLSPRLECNGTI

SEQ ID NO: 31154 - protein, 133 aa, Homo sapiens
  Payload ID: 6109
  Gene Symbol: FBXO27
  Gene Name: F-box protein 27
  ENSP ID: ENSP00000471772
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQEGLRKWMVQHGG

SEQ ID NO: 31155 - protein, 368 aa, Homo sapiens
  Payload ID: 6110
  Gene Symbol: FBXO28
  Gene Name: F-box protein 28
  Uniprot ID: Q9NVF7
  ENSP ID: ENSP00000355827
MAAAAEERMAEEGGGGQGDGGSSLASGSTQRQPPPPAPQHPQPGSQALPAPALAPDQLPQNNTLVALPIVAIENILSFMSYDEISQLRLVCKRMDLVCQRMLNQGFLKVERYHNLCQKQVKAQLPRRESERRNHSLARHADILAAVETRLSLLNMTFMKYVDSNLCCFIPGKVIDEIYRVLRYVNSTRAPQRAHEVLQELRDISSMAMEYFDEKIVPILKRKLPGSDVSGRLMGSPPVPGPSAALTTMQLFSKQNPSRQEVTKLQQQVKTNGAGVTVLRREISELRTKVQEQQKQLQDQDQKLLEQTQIIGEQNARLAELERKLREVMESAVGNSSGSGQNEESPRKRKKATEAIDSLRKSKRLRNRK

SEQ ID NO: 31156 - protein, 179 aa, Homo sapiens
  Payload ID: 6110
  Gene Symbol: FBXO28
  Gene Name: F-box protein 28
  Uniprot ID: Q9NVF7
  ENSP ID: ENSP00000416888
MAAAAEERMAEEGGGGQGDGGSSLASGSTQRQPPPPAPQHPQPGSQALPAPALAPDQLPQNNTLVALPIVAIENILSFMSYDEISQLRLVCKRMDLVCQRMLNQGFLKVERYHNLCQKQVKAQLPRRESERRNHSLARHADILAAVETRLSLLNMTFMKYVDSNLCCFIPGKFQDRLQP

SEQ ID NO: 31157 - protein, 126 aa, Homo sapiens
  Payload ID: 6110
  Gene Symbol: FBXO28
  Gene Name: F-box protein 28
  ENSP ID: ENSP00000430632
MAAAAEERMAEEGGGGQGDGGSSLASGSTQRQPPPPAPQHPQPGSQALPAPALAPDQLPQNNTLVALPIVAIENILSFMSYDEISQLRLVCKRMDLVCQRMLNQGFLKVERYHNLCQKQVKAQLPR

SEQ ID NO: 31158 - protein, 471 aa, Homo sapiens
  Payload ID: 6111
  Gene Symbol: FBXO3
  Gene Name: F-box protein 3
  Uniprot ID: Q9UK99
  ENSP ID: ENSP00000265651
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 31159 - protein, 415 aa, Homo sapiens
  Payload ID: 6111
  Gene Symbol: FBXO3
  Gene Name: F-box protein 3
  Uniprot ID: Q9UK99
  ENSP ID: ENSP00000408836
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLVS

SEQ ID NO: 31160 - protein, 129 aa, Homo sapiens
  Payload ID: 6111
  Gene Symbol: FBXO3
  Gene Name: F-box protein 3
  ENSP ID: ENSP00000431502
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKGVGIKMMLAL

SEQ ID NO: 31161 - protein, 430 aa, Homo sapiens
  Payload ID: 6111
  Gene Symbol: FBXO3
  Gene Name: F-box protein 3
  ENSP ID: ENSP00000431745
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLGYLMTSVTVTPTLETIT

SEQ ID NO: 31162 - protein, 410 aa, Homo sapiens
  Payload ID: 6111
  Gene Symbol: FBXO3
  Gene Name: F-box protein 3
  Uniprot ID: Q9UK99
  ENSP ID: ENSP00000433781
MAAMETETAPLTLESLPTDPLLLILSFLDYRDLINRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLVS

SEQ ID NO: 31163 - protein, 158 aa, Homo sapiens
  Payload ID: 6111
  Gene Symbol: FBXO3
  Gene Name: F-box protein 3
  ENSP ID: ENSP00000434001
MSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 31164 - protein, 172 aa, Homo sapiens
  Payload ID: 6111
  Gene Symbol: FBXO3
  Gene Name: F-box protein 3
  ENSP ID: ENSP00000434099
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGTKWLEIQLLLTCLL

SEQ ID NO: 31165 - protein, 158 aa, Homo sapiens; identical to SEQ ID NO: 31163
  Payload ID: 6111
  Gene Symbol: FBXO3
  Gene Name: F-box protein 3
  ENSP ID: ENSP00000435165

SEQ ID NO: 31166 - protein, 358 aa, Homo sapiens
  Payload ID: 6111
  Gene Symbol: FBXO3
  Gene Name: F-box protein 3
  ENSP ID: ENSP00000435680
MVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 31167 - protein, 745 aa, Homo sapiens
  Payload ID: 6112
  Gene Symbol: FBXO30
  Gene Name: F-box protein 30
  Uniprot ID: Q8TB52
  ENSP ID: ENSP00000237281
MEEELQHSHCVNCVSRRCMTRPEPGISCDLIGCPLVCGAVFHSCKADEHRLLCPFERVPCLNSDFGCPFTMARNKVAEHLEMCPASVVCCTMEWNRWPVSYADRKSYENLSRDVDEVAQLDMALALQDQRMLLESLKVATMMSKATDKVSKPREQISVKSSVPEIPHANGLVSVDEESYGALYQATVETTRSLAAALDILNTATRDIGMLNTSVPNDMDEQQNARESLEDQNLKDQDHLYEEEIGAVGGIDYNDTNQNAQSEQNGSSDLLCDLNTSSYDTSALCNGFPLENICTQVIDQNQNLHGDSKQSNLTNGDCVASSDGTSKPSSSLAVAAQLREIIPSSALPNGTVQHILMPDDEGEGELCWKKVDLGDVKNVDVLSFSHAPSFNFLSNSCWSKPKEDKAVDTSDLEVAEDPMGLQGIDLITAALLFCLGDSPGGRGISDSRMADIYHIDVGTQTFSLPSAILATSTMVGEIASASACDHANPQLSNPSPFQTLGLDLVLECVARYQPKQRSMFTFVCGQLFRRKEFSSHFKNVHGDIHAGLNGWMEQRCPLAYYGCTYSQRRFCPSIQGAKIIHDRHLRSFGVQPCVSTVLVEPARNCVLGLHNDHLSSLPFEVLQHIAGFLDGFSLCQLSCVSKLMRDVCGSLLQSRGMVILQWGKRKYPEGNSSWQIKEKVWRFSTAFCSVNEWKFADILSMADHLKKCSYNVVEKREEAIPLPCMCVTRELTKEGRSLRSVLKPVL

SEQ ID NO: 31168 - protein, 539 aa, Homo sapiens
  Payload ID: 6113
  Gene Symbol: FBXO31
  Gene Name: F-box protein 31
  Uniprot ID: Q5XUX0
  ENSP ID: ENSP00000310841
MAVCARLCGVGPSRGCRRRQQRRGPAETAAADSEPDTDPEEERIEASAGVGGGLCAGPSPPPPRCSLLELPPELLVEIFASLPGTDLPSLAQVCTKFRRILHTDTIWRRRCREEYGVCENLRKLEITGVSCRDVYAKLLHRYRHILGLWQPDIGPYGGLLNVVVDGLFIIGWMYLPPHDPHVDDPMRFKPLFRIHLMERKAATVECMYGHKGPHHGHIQIVKKDEFSTKCNQTDHHRMSGGRQEEFRTWLREEWGRTLEDIFHEHMQELILMKFIYTSQYDNCLTYRRIYLPPSRPDDLIKPGLFKGTYGSHGLEIVMLSFHGRRARGTKITGDPNIPAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMCFYGTGLIAGHGFTSPERTPGVFILFDEDRFGFVWLELKSFSLYSRVQATFRNADAPSPQAFDEMLKNIQSLTS

SEQ ID NO: 31169 - protein, 139 aa, Homo sapiens
  Payload ID: 6113
  Gene Symbol: FBXO31
  Gene Name: F-box protein 31
  ENSP ID: ENSP00000455772
MAVCARLCGVGPSRGCRRRQQRRGPAETAAADSEPDTDPEEERIEASAGVGGGLCAGPSPPPPRCSLLELPPELLVEIFASLPGTDLPSLAQVCTKRARVVAGRAPGSPSQALPSPGQRRPARAQMGHLVRMVASLGMP

SEQ ID NO: 31170 - protein, 145 aa, Homo sapiens
  Payload ID: 6113
  Gene Symbol: FBXO31
  Gene Name: F-box protein 31
  ENSP ID: ENSP00000457578
MYLPPHDPHVDDPMRFKPLFRIHLMERKAATVECMYGHKGPHHGHIQIVKKDEFSTKCNQTDHHRMSGGRQEEFRTWLREEWGRTLEDIFHEHMQELILMKFIYTSQYDNCLTYRRIYLPPSRPDDLIKPGLFKGTYGSHGLEIV

SEQ ID NO: 31171 - protein, 367 aa, Homo sapiens
  Payload ID: 6113
  Gene Symbol: FBXO31
  Gene Name: F-box protein 31
  ENSP ID: ENSP00000479703
MYLPPHDPHVDDPMRFKPLFRIHLMERKAATVECMYGHKGPHHGHIQIVKKDEFSTKCNQTDHHRMSGGRQEEFRTWLREEWGRTLEDIFHEHMQELILMKFIYTSQYDNCLTYRRIYLPPSRPDDLIKPGLFKGTYGSHGLEIVMLSFHGRRARGTKITGDPNIPAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMCFYGTGLIAGHGFTSPERTPGVFILFDEDRFGFVWLELKSFSLYSRVQATFRNADAPSPQAFDEMLKNIQSLTS

SEQ ID NO: 31172 - protein, 262 aa, Homo sapiens
  Payload ID: 6114
  Gene Symbol: FBXO32
  Gene Name: F-box protein 32
  Uniprot ID: Q969P5
  ENSP ID: ENSP00000390790
MPFLGQDWRSPGQNWVKTADGWKRFLDEKSGSFVSDLSSYCNKEVYNKENLFNSLNYDVAAKKRKKDMLNSKTKTQYFHQEKWIYVHKGSTKERHGYCTLGEAFNRLDFSTAILDSRRFNYVVRPAFKGLTFTDLPLCLQLNIMQRLSDGRDLVSLGQAAPDLHVLSEDRLLWKKLCQYHFSERQIRKRLILSDKGQLDWKKMYFKLVRCYPRKEQYGDTLQLCKHCHILSWKGTDHPCTANNPESCSVSLSPQDFINLFKF

SEQ ID NO: 31173 - protein, 355 aa, Homo sapiens
  Payload ID: 6114
  Gene Symbol: FBXO32
  Gene Name: F-box protein 32
  Uniprot ID: Q969P5
  ENSP ID: ENSP00000428205
MPFLGQDWRSPGQNWVKTADGWKRFLDEKSGSFVSDLSSYCNKEVYNKENLFNSLNYDVAAKKRKKDMLNSKTKTQYFHQEKWIYVHKGSTKERHGYCTLGEAFNRLDFSTAILDSRRFNYVVRLLELIAKSQLTSLSGIAQKNFMNILEKVVLKVLEDQQNIRLIRELLQTLYTSLCTLVQRVGKSVLVGNINMWVYRMETILHWQQQLNNIQITRPAFKGLTFTDLPLCLQLNIMQRLSDGRDLVSLGQAAPDLHVLSEDRLLWKKLCQYHFSERQIRKRLILSDKGQLDWKKMYFKLVRCYPRKEQYGDTLQLCKHCHILSWKGTDHPCTANNPESCSVSLSPQDFINLFKF

SEQ ID NO: 31174 - protein, 555 aa, Homo sapiens
  Payload ID: 6115
  Gene Symbol: FBXO33
  Gene Name: F-box protein 33
  Uniprot ID: Q7Z6M2
  ENSP ID: ENSP00000298097
MLLFLSVPQPRPPGARTRAGAARVARWRRLRLQQLRRLRGLLRVLRGRPGAGSRRRGRMALCGQAAGAASLPSELIVHIFSFLPAPDRLRASASCSHWRECLFYPALWPQLRICLRVSPAEQPRLEFLMRKCGWFVRELRVEFAAENYLSGGGPGDGGGADTGTGGEEVEALQLSARWLEVLRTYLELVLCVLVSIRNNRNLQKFSLFGDISVLQQQGSLSNTYLSKVDPDGKKIKQIQQLFEEILSNSRQLKWLSCGFMLEIVTPTSLSSLSNAVANTMEHLSLLDNNIPGNSTLITAVELERFVNLHSLALDFCDFTAEMARVLTDSNHVPLQRLSLLVHNVSVMHKSLDNMPNDEHWKALSRKSTSFRVYIMAFDIKSEDMLKILKPSIPLERIHFDSYITCVSGAIVDLISRQYDKFLTHFILMNDVIDTSGFPDLSDNRNEDPLVLLAWRCTKLSLLAIHGYTVWAHNLIAIARLRGSDLKVLEVTEESIDFDQGELADQDVDPVHNLIEQVSLGLGQPWHAVMDIESLSVFTEPNRHFYREMQSFSEDI

SEQ ID NO: 31175 - protein, 2 aa, Homo sapiens
  Payload ID: 6115
  Gene Symbol: FBXO33
  Gene Name: F-box protein 33
  ENSP ID: ENSP00000450974
MR

SEQ ID NO: 31176 - protein, 89 aa, Homo sapiens
  Payload ID: 6115
  Gene Symbol: FBXO33
  Gene Name: F-box protein 33
  ENSP ID: ENSP00000451277
MRKCGWFVRELRVEFAAENYLSGGGPGDGGGADTGTGGEEVEALQLSARWLEVLRTYLELVLCVLVSIRNNRLHGVGTQPHCHCSSSGL

SEQ ID NO: 31177 - protein, 711 aa, Homo sapiens
  Payload ID: 6116
  Gene Symbol: FBXO34
  Gene Name: F-box protein 34
  Uniprot ID: Q9NWN3
  ENSP ID: ENSP00000313159
MHLKPYWKLQKKEHPPEVSRETQRTPMNHQKAVNDETCKASHITSSVFPSASLGKASSRKPFGILSPNVLCSMSGKSPVESSLNVKTKKNAPSATIHQGEEEGPLDIWAVVKPGNTKEKIAFFASHQCSNRIGSMKIKSSWDIDGRATKRRKKSGDLKKAKVQVERMREVNSRCYQPEPFACGIEHCSVHYVSDSGDGVYAGRPLSVIQMVAFLEQRASALLASCSKNCTNSPAIVRFSGQSRGVPAVSESYSAPGACEEPTERGNLEVGEPQSEPVRVLDMVAKLESECLKRQGQREPGSLSRNNSFRRNVGRVLLANSTQADEGKTKKGVLEAPDTQVNPVGSVSVDCGPSRADRCSPKEDQAWDGASQDCPPLPAGVSFHIDSAELEPGSQTAVKNSNRYDVEMTDELVGLPFSSHTYSQASELPTDAVDCMSRELVSLTSRNPDQRKESLCISITVSKVDKDQPSILNSCEDPVPGMLFFLPPGQHLSDYSQLNESTTKESSEASQLEDAAGGDSASEEKSGSAEPFVLPASSVESTLPVLEASSWKKQVSHDFLETRFKIQQLLEPQQYMAFLPHHIMVKIFRLLPTKSLVALKCTCCYFKFIIEYYNIRPADSRWVRDPRYREDPCKQCKKKYVKGDVSLCRWHPKPYCQALPYGPGYWMCCHRSQKGFPGCKLGLHDNHWVPACHSFNRAIHKKAKGTEAEEEY

SEQ ID NO: 31178 - protein, 711 aa, Homo sapiens; identical to SEQ ID NO: 31177
  Payload ID: 6116
  Gene Symbol: FBXO34
  Gene Name: F-box protein 34
  Uniprot ID: Q9NWN3
  ENSP ID: ENSP00000394117

SEQ ID NO: 31179 - protein, 577 aa, Homo sapiens
  Payload ID: 6116
  Gene Symbol: FBXO34
  Gene Name: F-box protein 34
  ENSP ID: ENSP00000450877
MKIKSSWDIDGRATKRRKKSGDLKKAKVQVERMREVNSRCYQPEPFACGIEHCSVHYVSDSGDGVYAGRPLSVIQMVAFLEQRASALLASCSKNCTNSPAIVRFSGQSRGVPAVSESYSAPGACEEPTERGNLEVGEPQSEPVRVLDMVAKLESECLKRQGQREPGSLSRNNSFRRNVGRVLLANSTQADEGKTKKGVLEAPDTQVNPVGSVSVDCGPSRADRCSPKEDQAWDGASQDCPPLPAGVSFHIDSAELEPGSQTAVKNSNRYDVEMTDELVGLPFSSHTYSQASELPTDAVDCMSRELVSLTSRNPDQRKESLCISITVSKVDKDQPSILNSCEDPVPGMLFFLPPGQHLSDYSQLNESTTKESSEASQLEDAAGGDSASEEKSGSAEPFVLPASSVESTLPVLEASSWKKQVSHDFLETRFKIQQLLEPQQYMAFLPHHIMVKIFRLLPTKSLVALKCTCCYFKFIIEYYNIRPADSRWVRDPRYREDPCKQCKKKYVKGDVSLCRWHPKPYCQALPYGPGYWMCCHRSQKGFPGCKLGLHDNHWVPACHSFNRAIHKKAKGTEAEEEY

SEQ ID NO: 31180 - protein, 188 aa, Homo sapiens
  Payload ID: 6117
  Gene Symbol: FBXO36
  Gene Name: F-box protein 36
  Uniprot ID: Q8NEA4
  ENSP ID: ENSP00000283946
MASWLPETLFETVGQGPPPSKDYYQLLVTRSQVIFRWWKISLRSEYRSTKPGEAKETHEDFLENSHLQGQTALIFGARILDYVINLCKGKFDFLERLSDDLLLTIISYLDLEDIARLCQTSHRFAKLCMSDKLWEQIVQSTCDTITPDVRALAEDTGWRQLFFTNKLQLQRQLRKRKQKYGNLREKQP

SEQ ID NO: 31181 - protein, 157 aa, Homo sapiens
  Payload ID: 6117
  Gene Symbol: FBXO36
  Gene Name: F-box protein 36
  Uniprot ID: Q8NEA4
  ENSP ID: ENSP00000362756
MVIFRWWKISLRSEYRSTKPGEAKETHEDFLENSHLQGQTALIFGARILDYVINLCKGKFDFLERLSDDLLLTIISYLDLEDIARLCQTSHRFAKLCMSDKLWEQIVQSTCDTITPDVRALAEDTGWRQLFFTNKLQLQRQLRKRKQKYGNLREKQP

SEQ ID NO: 31182 - protein, 168 aa, Homo sapiens
  Payload ID: 6117
  Gene Symbol: FBXO36
  Gene Name: F-box protein 36
  ENSP ID: ENSP00000386673
MASWLPETLFETVGQGPPPSKDYYQLLVTRSQVIFRWWKISLRSEYRSTKPGEAKETHEDFLENSHLQGKFDFLERLSDDLLLTIISYLDLEDIARLCQTSHRFAKLCMSDKLWEQIVQSTCDTITPDVRALAEDTGWRQLFFTNKLQLQRQLRKRKQKYGNLREKQP

SEQ ID NO: 31183 - protein, 943 aa, Homo sapiens
  Payload ID: 6118
  Gene Symbol: FBXO38
  Gene Name: F-box protein 38
  Uniprot ID: Q6PIJ6
  ENSP ID: ENSP00000296701
MGPRKKSVKTCIMNNEIPEEMTADETKDYMNQLSHEVLCHIFRYLPLQDIMCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTSITVHDSESDDEEDSLELQEVWIPKNGTRRYSEREEKTGESVQSRELSEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 31184 - protein, 1188 aa, Homo sapiens
  Payload ID: 6118
  Gene Symbol: FBXO38
  Gene Name: F-box protein 38
  Uniprot ID: Q6PIJ6
  ENSP ID: ENSP00000342023
MGPRKKSVKTCIMNNEIPEEMTADETKDYMNQLSHEVLCHIFRYLPLQDIMCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTSITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDGTRSAFSFRTLPQGGSSGPAHDERTNGSGSGATGEDRRGSSQPESCDVQSNEDYPRRPLTRARSRLSHVLLVSESEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 31185 - protein, 1113 aa, Homo sapiens
  Payload ID: 6118
  Gene Symbol: FBXO38
  Gene Name: F-box protein 38
  Uniprot ID: Q6PIJ6
  ENSP ID: ENSP00000377895
MGPRKKSVKTCIMNNEIPEEMTADETKDYMNQLSHEVLCHIFRYLPLQDIMCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTSITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 31186 - protein, 943 aa, Homo sapiens; identical to SEQ ID NO: 31183
  Payload ID: 6118
  Gene Symbol: FBXO38
  Gene Name: F-box protein 38
  Uniprot ID: Q6PIJ6
  ENSP ID: ENSP00000426410

SEQ ID NO: 31187 - protein, 442 aa, Homo sapiens
  Payload ID: 6119
  Gene Symbol: FBXO39
  Gene Name: F-box protein 39
  Uniprot ID: Q8N4B4
  ENSP ID: ENSP00000321386
MDEESELIQPQDQSCWAFLPDLCLCRVFWWLGDRDRSRAALVCRKWNQMMYSAELWRYRTITFSGRPSRVHASEVESAVWYVKKFGRYLEHLEVKFMNPYNAVLTKKFQVTMRGLLSCLSKSNNRLKSLSIQYLELDRLVWRNSIRSSFISSLSFFLKKMGKRLDYLNLKGARLTVEQGCQILDSLSYMRNENVISELNIEDYFSHHLAVYNSPQFKKTMSTFHNLVSLNLNYNCISDELLENLCENASTLRTINIKCHVHDPHGQVIWGMSWAKLARQATNLKVNFFFERIMKYERLARILLQEIPIRSISLRSCYFSDPDCSMRPTLIDLLPTFRHTLQKLTCEFNNNHESLDEELHLLIISCRKLFYFKIWAFLDVSFVERILKSQKERQCALRVFKARIYTNRYETNEEDKTLQEIYRKYRKLIESELSYFVIVYSVM

SEQ ID NO: 31188 - protein, 36 aa, Homo sapiens
  Payload ID: 6119
  Gene Symbol: FBXO39
  Gene Name: F-box protein 39
  ENSP ID: ENSP00000458890
KIWAFLDVSFVERILKSQKERQCALRVFKGMIQGKE

SEQ ID NO: 31189 - protein, 50 aa, Homo sapiens
  Payload ID: 6119
  Gene Symbol: FBXO39
  Gene Name: F-box protein 39
  ENSP ID: ENSP00000459284
  MOD_RES (1)..(1): Any amino acid
XLDEELHLLIISCRKLFYFKIWAFLDVSFVERILKSQKERQCALRVFKGS

SEQ ID NO: 31190 - protein, 387 aa, Homo sapiens
  Payload ID: 6120
  Gene Symbol: FBXO4
  Gene Name: F-box protein 4
  Uniprot ID: Q9UKT5
  ENSP ID: ENSP00000281623
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKRHEWQDEFSHIMAMTDPAFGSSGRPLLVLSCISQGDVKRMPCFYLAHELHLNLLNHPWLVQDTEAETLTGFLNGIEWILEEVESKRAR

SEQ ID NO: 31191 - protein, 307 aa, Homo sapiens
  Payload ID: 6120
  Gene Symbol: FBXO4
  Gene Name: F-box protein 4
  Uniprot ID: Q9UKT5
  ENSP ID: ENSP00000296812
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKSKYSYVHF

SEQ ID NO: 31192 - protein, 305 aa, Homo sapiens
  Payload ID: 6120
  Gene Symbol: FBXO4
  Gene Name: F-box protein 4
  ENSP ID: ENSP00000421749
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKSPGYRG

SEQ ID NO: 31193 - protein, 64 aa, Homo sapiens
  Payload ID: 6120
  Gene Symbol: FBXO4
  Gene Name: F-box protein 4
  ENSP ID: ENSP00000424750
MAGSEPRSGTNSPPPPFSDWGRLEAAILSGWKTFWQSVSKERVARTTSREEVDEAASTLTRLPL

SEQ ID NO: 31194 - protein, 154 aa, Homo sapiens
  Payload ID: 6120
  Gene Symbol: FBXO4
  Gene Name: F-box protein 4
  ENSP ID: ENSP00000424991
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVRDGVSPCYPGWS

SEQ ID NO: 31195 - protein, 709 aa, Homo sapiens
  Payload ID: 6121
  Gene Symbol: FBXO40
  Gene Name: F-box protein 40
  Uniprot ID: Q9UH90
  ENSP ID: ENSP00000337510
MGKARRSPPGHHRHCEGCFNRHCHIPVEPNTSCLVISCHLLCGATFHMCKEAEHQLLCPLEQVPCLNSEYGCPLSMSRHKLAKHLQVCPASVVCCSMEWNRWPNVDSETTLHENIMKETPSEECLDTALALQDQKVLFRSLKMVELFPETREATEEEPTMNGETSVEEMGGAVGGVDIGLVPHGLSATNGEMAELSQEEREVLAKTKEGMDLVKFGQWENIFSKEHAASALTNSSASCESKNKNDSEKEQISSGHNMVEGEGAPKKKEPQENQKQQDVRTAMETTGLAPWQDGVLERLKTAVDAKDYNMYLVHNGRMLIHFGQMPACTPKERDFVYGKLEAQEVKTVYTFKVPVSYCGKRARLGDAMLSCKPSEHKAVDTSDLGITVEDLPKSDLIKTTLQCALERELKGHVISESRSIDGLFMDFATQTYNFEPEQFSSGTVLADLTAATPGGLHVELHSECVTRRHNKSSSAFTFTCNKFFRRDEFPLHFKNVHTDIQSCLNGWFQHRCPLAYLGCTFVQNHFRPPGQKAKVIYSQELKTFAIKPEVAPELSEGRKNNHLLGHGGKSQNSLTSLPLEILKYIAGFLDSVSLAQLSQVSVLMRNICATLLQERGMVLLQWKKKRYSHGGTSWRVHREIWQFSSLFSKIKSWEFNEVTSMSEHLKSCPFNIVEHKTDPILLTSMCQPREQARESLVSTFRIRPRGRYVS

SEQ ID NO: 31196 - protein, 875 aa, Homo sapiens
  Payload ID: 6122
  Gene Symbol: FBXO41
  Gene Name: F-box protein 41
  Uniprot ID: Q8TF61
  ENSP ID: ENSP00000295133
MASLDLPYRCPRCGEHKRFRSLSSLRAHLEYSHTYETLYILSKTNSICDGAAAAAAAAAAASGFPLAPEPAALLAVPGARREVFESTSFQGKEQAAGPSPAAPHLLHHHHHHAPLAHFPGDLVPASLPCEELAEPGLVPAAAARYALREIEIPLGELFARKSVASSACSTPPPGPGPGPCPGPASASPASPSPADVAYEEGLARLKIRALEKLEVDRRLERLSEEVEQKIAGQVGRLQAELERKAAELETARQESARLGREKEELEERASELSRQVDVSVELLASLKQDLVHKEQELSRKQQEVVQIDQFLKETAAREASAKLRLQQFIEELLERADRAERQLQVISSSCGSTPSASLGRGGGGGGAGPNARGPGRMREHHVGPAVPNTYAVSRHGSSPSTGASSRVPAASQSSGCYDSDSLELPRPEEGAPEDSGPGGLGTRAQAANGGSERSQPPRSSGLRRQAIQNWQRRPRRHSTEGEEGDVSDVGSRTTESEAEGPLDAPRPGPAMAGPLSSCRLSARPEGGSGRGRRAERVSPSRSNEVISPEILKMRAALFCIFTYLDTRTLLHAAEVCRDWRFVARHPAVWTRVLLENARVCSKFLAMLAQWCTQAHSLTLQNLKPRQRGKKESKEEYARSTRGCLEAGLESLLKAAGGNLLILRISHCPNILTDRSLWLASCYCRALQAVTYRSATDPVGHEVIWALGAGCREIVSLQVAPLHPCQQPTRFSNRCLQMIGRCWPHLRALGVGGAGCGVQGLASLARNCMRLQVLELDHVSEITQEVAAEVCREGLKGLEMLVLTATPVTPKALLHFNSICRNLKSIVVQIGIADYFKEPSSPEAQKLFEDMVTKLQALRRRPGFSKILHIKVEGGC

SEQ ID NO: 31197 - protein, 875 aa, Homo sapiens; identical to SEQ ID NO: 31196
  Payload ID: 6122
  Gene Symbol: FBXO41
  Gene Name: F-box protein 41
  Uniprot ID: Q8TF61
  ENSP ID: ENSP00000428646

SEQ ID NO: 31198 - protein, 875 aa, Homo sapiens; identical to SEQ ID NO: 31196
  Payload ID: 6122
  Gene Symbol: FBXO41
  Gene Name: F-box protein 41
  Uniprot ID: Q8TF61
  ENSP ID: ENSP00000430968

SEQ ID NO: 31199 - protein, 717 aa, Homo sapiens
  Payload ID: 6123
  Gene Symbol: FBXO42
  Gene Name: F-box protein 42
  Uniprot ID: Q6P3S6
  ENSP ID: ENSP00000364742
MASSSDSEDDSFMAVDQEETVLEGTMDQDEEPHPVLEAEETRHNRSMSELPEEVLEYILSFLSPYQEHKTAALVCKQWYRLIKGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 31200 - protein, 298 aa, Homo sapiens
  Payload ID: 6123
  Gene Symbol: FBXO42
  Gene Name: F-box protein 42
  ENSP ID: ENSP00000412416
MSSPPQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPP

SEQ ID NO: 31201 - protein, 298 aa, Homo sapiens; identical to SEQ ID NO: 31200
  Payload ID: 6123
  Gene Symbol: FBXO42
  Gene Name: F-box protein 42
  ENSP ID: ENSP00000415663

SEQ ID NO: 31202 - protein, 708 aa, Homo sapiens
  Payload ID: 6124
  Gene Symbol: FBXO43
  Gene Name: F-box protein 43
  Uniprot ID: Q4G163
  ENSP ID: ENSP00000403293
MSFKDKDERISCLEAYVTLTSKSSRFTDETEILKMSQRHSGQAGTEAGNGADSPPIVNSKYSTFRDFCSTSSFQDSGYNELKSCSFDNIDKEYLGKKEKGPTLLYEHPETSGLGLTHPLESPTQKKKCILPRKEKDKTPELCETPKISGKKCLPRRRLNVSFALLKGDFESQNSSLESSISQVINLEKNIPSSASGFSRANNFSPLVTSTLKTEEVTSCSQKLRLNFSQQKTSTIDDSKDDCSLFEVECISPIQGNNFKDSITHDFSDSSLCINDENACPELLGSSVSGTTCGTDEDIFVTPISNLVANIRFNASQILSPSPEVRGSISTPEDSGFNSLSLEKSEDSLSDQEGSFQELLQKHKGTPKVGDTIRKTRHLGRSRRLSTLREQSSQSETEEEKQIVHPDSEKRAAAASAISEGQLSSDESGDLTFSLKNLSKTPALQLVHELFMKSKRKRLQENSGHEFLEQGDGEKIAVLQCILAGLIGKKMGIEKLDILTELKYRNLKHILAMVLESLTAESLCSVWKVSRNWREIVVQDKNANRRRKFYITQLKTDSEGAVLNVEDAATRLQLLNRSALRSVQAQARIPGSQREQGSTLSPWGEVLTPLASSSVTHLSSKQEEYVKVAKTLFTDEALKPCPRCQSPAKYQPYKKRGLCSRTACGFDFCVLCLCAYHGSEECSRGAAKPRNRKDALPGSAQSKRNLKRL

SEQ ID NO: 31203 - protein, 36 aa, Homo sapiens
  Payload ID: 6124
  Gene Symbol: FBXO43
  Gene Name: F-box protein 43
  ENSP ID: ENSP00000429759
MSFKDKDERISCLEAYVTLTSKSSRFTDGKSFHFNK

SEQ ID NO: 31204 - protein, 224 aa, Homo sapiens
  Payload ID: 6125
  Gene Symbol: FBXO44
  Gene Name: F-box protein 44
  Uniprot ID: Q9H4M3
  ENSP ID: ENSP00000251546
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVRSQARLRVQVPAVRSAPVVRARASGDLPARPGDHPAEERCQVEGGLPHILQLPARRPLHLVSARRRGHSLLGRLVRPEGHQQQHHHRAPAALTPPEPPSAEP

SEQ ID NO: 31205 - protein, 255 aa, Homo sapiens
  Payload ID: 6125
  Gene Symbol: FBXO44
  Gene Name: F-box protein 44
  Uniprot ID: Q9H4M3
  ENSP ID: ENSP00000251547
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVKKYFVTSYYTCLKSQVVDLKAEGYWEELMDTTRPDIEVKDWFAARPDCGSKYQLCVQLLSSAHAPLGTFQPDPATIQQKSDAKWREVSHTFSNYPPGVRYIWFQHGGVDTHYWAGWYGPRVTNSSITIGPPLP

SEQ ID NO: 31206 - protein, 224 aa, Homo sapiens; identical to SEQ ID NO: 31204
  Payload ID: 6125
  Gene Symbol: FBXO44
  Gene Name: F-box protein 44
  Uniprot ID: Q9H4M3
  ENSP ID: ENSP00000365951

SEQ ID NO: 31207 - protein, 224 aa, Homo sapiens; identical to SEQ ID NO: 31204
  Payload ID: 6125
  Gene Symbol: FBXO44
  Gene Name: F-box protein 44
  Uniprot ID: Q9H4M3
  ENSP ID: ENSP00000365953

SEQ ID NO: 31208 - protein, 256 aa, Homo sapiens
  Payload ID: 6125
  Gene Symbol: FBXO44
  Gene Name: F-box protein 44
  ENSP ID: ENSP00000365959
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQHLPQVPGGGPQGRRVLGGADGYHTAGHRGQGLVRSQARLRVQVPAVRSAPVVRARASGDLPARPGDHPAEERCQVEGGLPHILQLPARRPLHLVSARRRGHSLLGRLVRPEGHQQQHHHRAPAALTPPEPPSAEP

SEQ ID NO: 31209 - protein, 255 aa, Homo sapiens; identical to SEQ ID NO: 31205
  Payload ID: 6125
  Gene Symbol: FBXO44
  Gene Name: F-box protein 44
  Uniprot ID: Q9H4M3
  ENSP ID: ENSP00000365961

SEQ ID NO: 31210 - protein, 165 aa, Homo sapiens
  Payload ID: 6125
  Gene Symbol: FBXO44
  Gene Name: F-box protein 44
  ENSP ID: ENSP00000389820
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVRSQARLRVQVPAVRSAPVVRARASGDLPARPGDHPAEERCQVE

SEQ ID NO: 31211 - protein, 148 aa, Homo sapiens
  Payload ID: 6125
  Gene Symbol: FBXO44
  Gene Name: F-box protein 44
  ENSP ID: ENSP00000473420
  MOD_RES (1)..(1): Any amino acid
XHRNLLHNPCAEEGFEFWSLDVNGGDEWKVEDLSRDQRKEFPNDQVRSQARLRVQVPAVRSAPVVRARASGDLPARPGDHPAEERCQVEGGLPHILQLPARRPLHLVSARRRGHSLLGRLVRPEGHQQQHHHRAPAALTPPEPPSAEP

SEQ ID NO: 31212 - protein, 132 aa, Homo sapiens
  Payload ID: 6125
  Gene Symbol: FBXO44
  Gene Name: F-box protein 44
  ENSP ID: ENSP00000473653
QVPGGGPQGRRVLGGADGYHTAGHRGQGLVRSQARLRVQVPAVRSAPVVRARASGDLPARPGDHPAEERCQVEGGLPHILQLPARRPLHLVSARRRGHSLLGRLVRPEGHQQQHHHRAPAALTPPEPPSAEP

SEQ ID NO: 31213 - protein, 286 aa, Homo sapiens
  Payload ID: 6126
  Gene Symbol: FBXO45
  Gene Name: F-box protein 45
  Uniprot ID: P0C2W1
  ENSP ID: ENSP00000310332
MAAPAPGAGAASGGAGCSGGGAGAGAGSGSGAAGAGGRLPSRVLELVFSYLELSELRSCALVCKHWYRCLHGDENSEVWRSLCARSLAEEALRTDILCNLPSYKAKIRAFQHAFSTNDCSRNVYIKKNGFTLHRNPIAQSTDGARTKIGFSEGRHAWEVWWEGPLGTVAVIGIATKRAPMQCQGYVALLGSDDQSWGWNLVDNNLLHNGEVNGSFPQCNNAPKYQIGERIRVILDMEDKTLAFERGYEFLGVAFRGLPKVCLYPAVSAVYGNTEVTLVYLGKPLDG

SEQ ID NO: 31214 - protein, 107 aa, Homo sapiens
  Payload ID: 6126
  Gene Symbol: FBXO45
  Gene Name: F-box protein 45
  ENSP ID: ENSP00000389868
MQCQGYVALLGSDDQSWGWNLVDNNLLHNGEVNGSFPQCNNAPKYQIGERIRVILDMEDKTLAFERGYEFLGVAFRGLPKVCLYPAVSAVYGNTEVTLVYLGKPLDG

SEQ ID NO: 31215 - protein, 603 aa, Homo sapiens
  Payload ID: 6127
  Gene Symbol: FBXO46
  Gene Name: F-box protein 46
  Uniprot ID: Q6PJ61
  ENSP ID: ENSP00000410007
MDRGSLLPFQLWCPRPFGTYSQNQPRPPSAALKPSACPEPGGGAEPDHGPAHSENTPPALATEVPASQPAPLLSAAAAGDEGRVLLDTWYVIKPGNTKEKVAFFVAHQCGGGSRASSMKVKGHWGSDSSKAKRRRRCLDPTKAPPDPGGREGPPAAEEGPASAGEDVDLLSVAEMVALVEQRAALALQSYPRPTTPAPVVFVSAEQGGPAKGVGSERRSGGGDCSRVAEAVAHFEAQRDSPPTKGLRKEERPGPGPGEVRIAFRISNGREPRAPDSGLPSGGGGRPGCAYPGSPGPGARAKDKITCDLYQLISPSRDALPSNVEFLLARADEASEGDSPAPARPEDTPPAPPPPPARDCGASGFHVDVVVTGVVDECIFFGKDGTKNVKEETVCLTVSPEEPPPPGQLFFLQNRGPDGPPEPPPADSPATAPGPDDAEGTADTSLCRLYRHVSHDFLEIRFKIQRLLEPRQYMLLLPEHVLVKIFSFLPTRALAALKCTCHHFKGIIEAFGVRATDSRWSRDPLYRDDPCKQCRKRYEKGDVSLCRWHPKPYHHDLPYGRSYWMCCRRADRETPGCRLGLHDNNWVLPCNGPGGGRAGREEGR

SEQ ID NO: 31216 - protein, 13 aa, Homo sapiens
  Payload ID: 6127
  Gene Symbol: FBXO46
  Gene Name: F-box protein 46
  ENSP ID: ENSP00000465591
MDRGSLLPFQLWC

SEQ ID NO: 31217 - protein, 184 aa, Homo sapiens
  Payload ID: 6127
  Gene Symbol: FBXO46
  Gene Name: F-box protein 46
  ENSP ID: ENSP00000468336
MDRGSLLPFQLWCPRPFGTYSQNQPRPPSAALKPSACPEPGGGAEPDHGPAHSENTPPALATEVPASQPAPLLSAAAAGDEGRVLLDTWYVIKPGNTKEKVAFFVAHQCGGGSRASSMKVKGHWGSDSSKAKRRRRCLDPTKAPPDPGGREGPPAAEEGPASAGEDVDLLSVAEMVALVEQRAA

SEQ ID NO: 31218 - protein, 452 aa, Homo sapiens
  Payload ID: 6128
  Gene Symbol: FBXO47
  Gene Name: F-box protein 47
  Uniprot ID: Q5MNV8
  ENSP ID: ENSP00000367319
MASRINTNFTLIPNQKLRRSNRQTSCYSKTLGSGFQPISTFGNFKALPLEIFQIILKYLSVKDISMLSMVSKTVSQHIINYISTSSGSKRLLLQDFHNLELPDRRQDSAILEHYRSLGLLFKRCTLLLPTKERLKYIHKILTEVSCFKFNGCAAPMQCLGLTCYGMFLQTLTAGWDELECHRVYNFLCELTNLCRKIQMAVCSKPGSAQKLELRIRLFCRNVLLDHWTHRSDSAFWLTRILKPWPMVNQARLLYIIFGPISPQDGQVVWQEMIEEPTDEFSLKGLADAIKLLYDASTKEWTADDVISLVDELSVVPREWLLENNARLLMLSGNNICFSFMASKAVNGRTIELARLVVFLALVCEKELYCMDWTVKMMQKVCKVFSTPVERKNFLQNVANAFACVIMEMLQSIMSGDRDEDDRSFLNLFHLVHAQANFHKEVLYLTMNTPLST

SEQ ID NO: 31219 - protein, 155 aa, Homo sapiens
  Payload ID: 6129
  Gene Symbol: FBXO48
  Gene Name: F-box protein 48
  Uniprot ID: Q5FWF7
  ENSP ID: ENSP00000367193
MHKNSKRNNNLRVSHTEANSVDAEKEKNESQNNFFELLPAEITFKIFSQLDIRSLCRASLTCRSWNDTIRNSDSLWKPHCMTVRAVCRREIDDDLESGYSWRVILLRNYQKSKVKHEWLSGRYSNICSPISLPEKIMYPMDADTWGEILEAELER

SEQ ID NO: 31220 - protein, 447 aa, Homo sapiens
  Payload ID: 6130
  Gene Symbol: FBXO5
  Gene Name: F-box protein 5
  Uniprot ID: Q9UKT4
  ENSP ID: ENSP00000229758
MSRRPCSCALRPPRCSCSASPSAVTAAGRPRPSDSCKEESSTLSVKMKCDFNCNHVHSGLKLVKPDDIGRLVSYTPAYLEGSCKDCIKDYERLSCIGSPIVSPRIVQLETESKRLHNKENQHVQQTLNSTNEIEALETSRLYEDSGYSSFSLQSGLSEHEEGSLLEENFGDSLQSCLLQIQSPDQYPNKNLLPVLHFEKVVCSTLKKNAKRNPKVDREMLKEIIARGNFRLQNIIGRKMGLECVDILSELFRRGLRHVLATILAQLSDMDLINVSKVSTTWKKILEDDKGAFQLYSKAIQRVTENNNKFSPHASTREYVMFRTPLASVQKSAAQTSLKKDAQTKLSNQGDQKGSTYSRHNEFSEVAKTLKKNESLKACIRCNSPAKYDCYLQRATCKREGCGFDYCTKCLCNYHTTKDCSDGKLLKASCKIGPLPGTKKSKKNLRRL

SEQ ID NO: 31221 - protein, 401 aa, Homo sapiens
  Payload ID: 6130
  Gene Symbol: FBXO5
  Gene Name: F-box protein 5
  Uniprot ID: Q9UKT4
  ENSP ID: ENSP00000356210
MKCDFNCNHVHSGLKLVKPDDIGRLVSYTPAYLEGSCKDCIKDYERLSCIGSPIVSPRIVQLETESKRLHNKENQHVQQTLNSTNEIEALETSRLYEDSGYSSFSLQSGLSEHEEGSLLEENFGDSLQSCLLQIQSPDQYPNKNLLPVLHFEKVVCSTLKKNAKRNPKVDREMLKEIIARGNFRLQNIIGRKMGLECVDILSELFRRGLRHVLATILAQLSDMDLINVSKVSTTWKKILEDDKGAFQLYSKAIQRVTENNNKFSPHASTREYVMFRTPLASVQKSAAQTSLKKDAQTKLSNQGDQKGSTYSRHNEFSEVAKTLKKNESLKACIRCNSPAKYDCYLQRATCKREGCGFDYCTKCLCNYHTTKDCSDGKLLKASCKIGPLPGTKKSKKNLRRL

SEQ ID NO: 31222 - protein, 293 aa, Homo sapiens
  Payload ID: 6131
  Gene Symbol: FBXO6
  Gene Name: F-box protein 6
  Uniprot ID: Q9NRD1
  ENSP ID: ENSP00000365944
MDAPHSKAALDSINELPENILLELFTHVPARQLLLNCRLVCSLWRDLIDLMTLWKRKCLREGFITKDWDQPVADWKIFYFLRSLHRNLLRNPCAEEDMFAWQIDFNGGDRWKVESLPGAHGTDFPDPKVKKYFVTSYEMCLKSQLVDLVAEGYWEELLDTFRPDIVVKDWFAARADCGCTYQLKVQLASADYFVLASFEPPPVTIQQWNNATWTEVSYTFSDYPRGVRYILFQHGGRDTQYWAGWYGPRVTNSSIVVSPKMTRNQASSEAQPGQKHGQEEAAQSPYRAVVQIF

SEQ ID NO: 31223 - protein, 249 aa, Homo sapiens
  Payload ID: 6131
  Gene Symbol: FBXO6
  Gene Name: F-box protein 6
  ENSP ID: ENSP00000388781
  MOD_RES (1)..(1): Any amino acid
XNELPENILLELFTHVPARQLLLNCRLVCSLWRDLIDLMTLWKRKCLREGFITKDWDQPVADWKIFYFLRSLHRNLLRNPCAEEDMFAWQIDFNGGDRWKVESLPGAHGTDFPDPKVKKYFVTSYEFAARADCGCTYQLKVQLASADYFVLASFEPPPVTIQQWNNATWTEVSYTFSDYPRGVRYILFQHGGRDTQYWAGWYGPRVTNSSIVVSPKMTRNQASSEAQPGQKHGQEEAAQSPYRAVVQIF

SEQ ID NO: 31224 - protein, 522 aa, Homo sapiens
  Payload ID: 6132
  Gene Symbol: FBXO7
  Gene Name: F-box protein 7
  Uniprot ID: Q9Y3I1
  ENSP ID: ENSP00000266087
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 31225 - protein, 408 aa, Homo sapiens
  Payload ID: 6132
  Gene Symbol: FBXO7
  Gene Name: F-box protein 7
  Uniprot ID: Q9Y3I1
  ENSP ID: ENSP00000380571
MQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 31226 - protein, 443 aa, Homo sapiens
  Payload ID: 6132
  Gene Symbol: FBXO7
  Gene Name: F-box protein 7
  Uniprot ID: Q9Y3I1
  ENSP ID: ENSP00000388547
MARPPGGSGPLLDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 31227 - protein, 49 aa, Homo sapiens
  Payload ID: 6132
  Gene Symbol: FBXO7
  Gene Name: F-box protein 7
  ENSP ID: ENSP00000395823
MRLRVRLLKRTWPLEVPETEPTLGHLRSHLRQSLLCTWGYRFRAFFTPE

SEQ ID NO: 31228 - protein, 54 aa, Homo sapiens
  Payload ID: 6132
  Gene Symbol: FBXO7
  Gene Name: F-box protein 7
  ENSP ID: ENSP00000404388
MQDEQPSDSFQGQAAQSGVWNDDSMLGPSQNFEAESIQDNAHMAEGTGFYPSEP

SEQ ID NO: 31229 - protein, 41 aa, Homo sapiens
  Payload ID: 6132
  Gene Symbol: FBXO7
  Gene Name: F-box protein 7
  ENSP ID: ENSP00000406155
MRLRVRLLKRTWPLEVPETEPTLGHLRSHLRQSLLCTWGYS

SEQ ID NO: 31230 - protein, 319 aa, Homo sapiens
  Payload ID: 6133
  Gene Symbol: FBXO8
  Gene Name: F-box protein 8
  Uniprot ID: Q9NRD0
  ENSP ID: ENSP00000377280
MGQGLWRVVRNQQLQQEGYSEQGYLTREQSRRMAASNISNTNHRKQVQGGIDIYHLLKARKSKEQEGFINLEMLPPELSFTILSYLNATDLCLASCVWQDLANDELLWQGLCKSTWGHCSIYNKNPPLGFSFRKLYMQLDEGSLTFNANPDEGVNYFMSKGILDDSPKEIAKFIFCTRTLNWKKLRIYLDERRDVLDDLVTLHNFRNQFLPNALREFFRHIHAPEERGEYLETLITKFSHRFCACNPDLMRELGLSPDAVYVLCYSLILLSIDLTSPHVKNKMSKREFIRNTRRAAQNISEDFVGHLYDNIYLIGHVAA

SEQ ID NO: 31231 - protein, 278 aa, Homo sapiens
  Payload ID: 6133
  Gene Symbol: FBXO8
  Gene Name: F-box protein 8
  Uniprot ID: Q9NRD0
  ENSP ID: ENSP00000422905
MGQGLWRVVRNQQLQQEGYSEQGYLTREQSRRMAASNISNTNHRKQVQGGIDIYHLLKDLANDELLWQGLCKSTWGHCSIYNKNPPLGFSFRKLYMQLDEGSLTFNANPDEGVNYFMSKGILDDSPKEIAKFIFCTRTLNWKKLRIYLDERRDVLDDLVTLHNFRNQFLPNALREFFRHIHAPEERGEYLETLITKFSHRFCACNPDLMRELGLSPDAVYVLCYSLILLSIDLTSPHVKNKMSKREFIRNTRRAAQNISEDFVGHLYDNIYLIGHVAA

SEQ ID NO: 31232 - protein, 169 aa, Homo sapiens
  Payload ID: 6133
  Gene Symbol: FBXO8
  Gene Name: F-box protein 8
  ENSP ID: ENSP00000427313
MGQGLWRVVRNQQLQQEGYSEQGYLTREQSRRMAASNISNTNHRKQVQGGIDIYHLLKARKSKEQEGFINLEMLPPELSFTILSYLNATDLCLASCVWQDLANDELLWQGLCKSTWGHCSIYNKNPPLGFSFRKLYMQLDEGSLTFNANPDEPQGTRFSKGHRSCHGYG

SEQ ID NO: 31233 - protein, 184 aa, Homo sapiens
  Payload ID: 6133
  Gene Symbol: FBXO8
  Gene Name: F-box protein 8
  ENSP ID: ENSP00000427506
MGQGLWRVVRNQQLQQEGYSEQGYLTREQSRRMAASNISNTNHRKQVQGGIDIYHLLKARKSKEQEGFINLEMLPPELSFTILSYLNATDLCLASCVWQDLANDELLWQGLCKSTWGHCSIYNKNPPLGFSFRKLYMQLDEGSLTFNANPDEGVNYFMSKGILDDSPKEIAKFIFCTRTLNWKK

SEQ ID NO: 31234 - protein, 232 aa, Homo sapiens
  Payload ID: 6133
  Gene Symbol: FBXO8
  Gene Name: F-box protein 8
  ENSP ID: ENSP00000482582
MQLTFAWLHVFGRTLRMMNFSGKGCANPWGHCSIYNKNPPLGFSFRKLYMQLDEGSLTFNANPDEGVNYFMSKGILDDSPKEIAKFIFCTRTLNWKKLRIYLDERRDVLDDLVTLHNFRNQFLPNALREFFRHIHAPEERGEYLETLITKFSHRFCACNPDLMRELGLSPDAVYVLCYSLILLSIDLTSPHVKNKMSKREFIRNTRRAAQNISEDFVGHLYDNIYLIGHVAA

SEQ ID NO: 31235 - protein, 278 aa, Homo sapiens; identical to SEQ ID NO: 31231
  Payload ID: 6133
  Gene Symbol: FBXO8
  Gene Name: F-box protein 8
  Uniprot ID: Q9NRD0
  ENSP ID: ENSP00000484517

SEQ ID NO: 31236 - protein, 447 aa, Homo sapiens
  Payload ID: 6134
  Gene Symbol: FBXO9
  Gene Name: F-box protein 9
  Uniprot ID: Q9UK97
  ENSP ID: ENSP00000244426
MPDIIWVFPPQAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 31237 - protein, 437 aa, Homo sapiens
  Payload ID: 6134
  Gene Symbol: FBXO9
  Gene Name: F-box protein 9
  Uniprot ID: Q9UK97
  ENSP ID: ENSP00000326968
MAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 31238 - protein, 403 aa, Homo sapiens
  Payload ID: 6134
  Gene Symbol: FBXO9
  Gene Name: F-box protein 9
  Uniprot ID: Q9UK97
  ENSP ID: ENSP00000359977
MFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 31239 - protein, 48 aa, Homo sapiens
  Payload ID: 6134
  Gene Symbol: FBXO9
  Gene Name: F-box protein 9
  ENSP ID: ENSP00000417154
MFRAQWMFELAPGVSSSNLENRPCRAARGSLQKTSADTKGKQEQAKEE

SEQ ID NO: 31240 - protein, 191 aa, Homo sapiens
  Payload ID: 6134
  Gene Symbol: FBXO9
  Gene Name: F-box protein 9
  ENSP ID: ENSP00000417349
  MOD_RES (1)..(1): Any amino acid
XFPDGHVMMLTTPEEPQSIVPRLRTRNTRTDAILLGHYRLSQDTDNQTKVFAVITKKKEETGQSFICESYHLVATCCWRLHFPLMGSWSLGSSSLRDRESCFDCDCRFPEKPLDYKYRYFRRVPVQEADQSFHVGLQLCSSGHQRFNKLIWIHHSCHITYKSTGETAVSAFEIDKMYTPLFFARVRSYTAF

SEQ ID NO: 31241 - protein, 145 aa, Homo sapiens
  Payload ID: 6134
  Gene Symbol: FBXO9
  Gene Name: F-box protein 9
  ENSP ID: ENSP00000418858
MFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHIS

SEQ ID NO: 31242 - protein, 118 aa, Homo sapiens
  Payload ID: 6134
  Gene Symbol: FBXO9
  Gene Name: F-box protein 9
  ENSP ID: ENSP00000420536
MFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSY

SEQ ID NO: 31243 - protein, 150 aa, Homo sapiens
  Payload ID: 6134
  Gene Symbol: FBXO9
  Gene Name: F-box protein 9
  ENSP ID: ENSP00000477487
VEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARIYEQISVT

SEQ ID NO: 31244 - protein, 1043 aa, Homo sapiens
  Payload ID: 6135
  Gene Symbol: FBXO18
  Gene Name: F-box protein, helicase, 18
  Uniprot ID: Q8NFZ0
  ENSP ID: ENSP00000355415
MRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 31245 - protein, 1094 aa, Homo sapiens
  Payload ID: 6135
  Gene Symbol: FBXO18
  Gene Name: F-box protein, helicase, 18
  Uniprot ID: Q8NFZ0
  ENSP ID: ENSP00000369335
MSYEVTSGCHWTCQVPESCDNGLHCAGPLGHLHRRCQRTSAHLLVFTEHAEMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 31246 - protein, 986 aa, Homo sapiens
  Payload ID: 6135
  Gene Symbol: FBXO18
  Gene Name: F-box protein, helicase, 18
  ENSP ID: ENSP00000380439
MAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEMESHHVGQAGLELPTSEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 31247 - protein, 283 aa, Homo sapiens; identical to SEQ ID NO: 31150
  Payload ID: 6136
  Gene Symbol:
  Gene Name: FBXO27
  ENSP ID: ENSP00000489017

SEQ ID NO: 31248 - protein, 133 aa, Homo sapiens; identical to SEQ ID NO: 31154
  Payload ID: 6136
  Gene Symbol:
  Gene Name: FBXO27
  ENSP ID: ENSP00000489321

SEQ ID NO: 31249 - protein, 100 aa, Homo sapiens; identical to SEQ ID NO: 31153
  Payload ID: 6136
  Gene Symbol:
  Gene Name: FBXO27
  ENSP ID: ENSP00000489413
  MOD_RES (1)..(1): Any amino acid

SEQ ID NO: 31250 - protein, 283 aa, Homo sapiens; identical to SEQ ID NO: 31150
  Payload ID: 6136
  Gene Symbol:
  Gene Name: FBXO27
  ENSP ID: ENSP00000489487

SEQ ID NO: 31251 - protein, 282 aa, Homo sapiens; identical to SEQ ID NO: 31152
  Payload ID: 6136
  Gene Symbol:
  Gene Name: FBXO27
  ENSP ID: ENSP00000489600

SEQ ID NO: 31252 - protein, 178 aa, Homo sapiens
  Payload ID: 6137
  Gene Symbol: FCAR
  Gene Name: Fc fragment of IgA receptor
  Uniprot ID: P24071
  ENSP ID: ENSP00000338058
MDPKQTTLLCLGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 31253 - protein, 191 aa, Homo sapiens
  Payload ID: 6137
  Gene Symbol: FCAR
  Gene Name: Fc fragment of IgA receptor
  Uniprot ID: P24071
  ENSP ID: ENSP00000338257
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 31254 - protein, 287 aa, Homo sapiens
  Payload ID: 6137
  Gene Symbol: FCAR
  Gene Name: Fc fragment of IgA receptor
  Uniprot ID: P24071
  ENSP ID: ENSP00000347714
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 31255 - protein, 275 aa, Homo sapiens
  Payload ID: 6137
  Gene Symbol: FCAR
  Gene Name: Fc fragment of IgA receptor
  Uniprot ID: P24071
  ENSP ID: ENSP00000352218
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 31256 - protein, 209 aa, Homo sapiens
  Payload ID: 6137
  Gene Symbol: FCAR
  Gene Name: Fc fragment of IgA receptor
  Uniprot ID: P24071
  ENSP ID: ENSP00000375603
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRLHPPRLHDAELDPHGRGRTGPRGSLGHTG

SEQ ID NO: 31257 - protein, 253 aa, Homo sapiens
  Payload ID: 6137
  Gene Symbol: FCAR
  Gene Name: Fc fragment of IgA receptor
  Uniprot ID: P24071
  ENSP ID: ENSP00000375604
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 31258 - protein, 265 aa, Homo sapiens
  Payload ID: 6137
  Gene Symbol: FCAR
  Gene Name: Fc fragment of IgA receptor
  Uniprot ID: P24071
  ENSP ID: ENSP00000375605
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 31259 - protein, 179 aa, Homo sapiens
  Payload ID: 6137
  Gene Symbol: FCAR
  Gene Name: Fc fragment of IgA receptor
  Uniprot ID: P24071
  ENSP ID: ENSP00000375606
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 31260 - protein, 239 aa, Homo sapiens
  Payload ID: 6137
  Gene Symbol: FCAR
  Gene Name: Fc fragment of IgA receptor
  Uniprot ID: P24071
  ENSP ID: ENSP00000473814
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 31261 - protein, 227 aa, Homo sapiens
  Payload ID: 6137
  Gene Symbol: FCAR
  Gene Name: Fc fragment of IgA receptor
  Uniprot ID: P24071
  ENSP ID: ENSP00000474512
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 31262 - protein, 227 aa, Homo sapiens; identical to SEQ ID NO: 31261
  Payload ID: 6137
  Gene Symbol: FCAR
  Gene Name: Fc fragment of IgA receptor
  Uniprot ID: P24071
  ENSP ID: ENSP00000477584

SEQ ID NO: 31263 - protein, 209 aa, Homo sapiens; identical to SEQ ID NO: 31256
  Payload ID: 6137
  Gene Symbol: FCAR
  Gene Name: Fc fragment of IgA receptor
  Uniprot ID: P24071
  ENSP ID: ENSP00000477610

SEQ ID NO: 31264 - protein, 209 aa, Homo sapiens; identical to SEQ ID NO: 31256
  Payload ID: 6137
  Gene Symbol: FCAR
  Gene Name: Fc fragment of IgA receptor
  Uniprot ID: P24071
  ENSP ID: ENSP00000477643

SEQ ID NO: 31265 - protein, 275 aa, Homo sapiens; identical to SEQ ID NO: 31255
  Payload ID: 6137
  Gene Symbol: FCAR
  Gene Name: Fc fragment of IgA receptor
  Uniprot ID: P24071
  ENSP ID: ENSP00000477656

SEQ ID NO: 31266 - protein, 178 aa, Homo sapiens; identical to SEQ ID NO: 31252
  Payload ID: 6137
  Gene Symbol: FCAR
  Gene Name: Fc fragment of IgA receptor
  Uniprot ID: P24071
  ENSP ID: ENSP00000477673

SEQ ID NO: 31267 - protein, 265 aa, Homo sapiens; identical to SEQ ID NO: 31258
  Payload ID: 6137
  Gene Symbol: FCAR
  Gene Name: Fc fragment of IgA receptor
  Uniprot ID: P24071
  ENSP ID: ENSP00000477966

SEQ ID NO: 31268 - protein, 287 aa, Homo sapiens
  Payload ID: 6137
  Gene Symbol: FCAR
  Gene Name: Fc fragment of IgA receptor
  ENSP ID: ENSP00000477977
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSNTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 31269 - protein, 253 aa, Homo sapiens; identical to SEQ ID NO: 31257
  Payload ID: 6137
  Gene Symbol: FCAR
  Gene Name: Fc fragment of IgA receptor
  Uniprot ID: P24071
  ENSP ID: ENSP00000478075

SEQ ID NO: 31270 - protein, 265 aa, Homo sapiens; identical to SEQ ID NO: 31258
  Payload ID: 6137
  Gene Symbol: FCAR
  Gene Name: Fc fragment of IgA receptor
  Uniprot ID: P24071
  ENSP ID: ENSP00000478163

SEQ ID NO: 31271 - protein, 191 aa, Homo sapiens; identical to SEQ ID NO: 31253
  Payload ID: 6137
  Gene Symbol: FCAR
  Gene Name: Fc fragment of IgA receptor
  Uniprot ID: P24071
  ENSP ID: ENSP00000478233

SEQ ID NO: 31272 - protein, 178 aa, Homo sapiens; identical to SEQ ID NO: 31252
  Payload ID: 6137
  Gene Symbol: FCAR
  Gene Name: Fc fragment of IgA receptor
  Uniprot ID: P24071
  ENSP ID: ENSP00000478315

SEQ ID NO: 31273 - protein, 253 aa, Homo sapiens
  Payload ID: 6137
  Gene Symbol: FCAR
  Gene Name: Fc fragment of IgA receptor
  ENSP ID: ENSP00000478434
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSNTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 31274 - protein, 117 aa, Homo sapiens
  Payload ID: 6137
  Gene Symbol: FCAR
  Gene Name: Fc fragment of IgA receptor
  ENSP ID: ENSP00000478442
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSNTLELVVTDSIHQDYTT

SEQ ID NO: 31275 - protein, 209 aa, Homo sapiens; identical to SEQ ID NO: 31256
  Payload ID: 6137
  Gene Symbol: FCAR
  Gene Name: Fc fragment of IgA receptor
  Uniprot ID: P24071
  ENSP ID: ENSP00000478454

SEQ ID NO: 31276 - protein, 287 aa, Homo sapiens; identical to SEQ ID NO: 31254
  Payload ID: 6137
  Gene Symbol: FCAR
  Gene Name: Fc fragment of IgA receptor
  Uniprot ID: P24071
  ENSP ID: ENSP00000478465

SEQ ID NO: 31277 - protein, 142 aa, Homo sapiens
  Payload ID: 6137
  Gene Symbol: FCAR
  Gene Name: Fc fragment of IgA receptor
  ENSP ID: ENSP00000478574
MDPKQTTLLCLVLCLGQRIQAQEGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 31278 - protein, 227 aa, Homo sapiens; identical to SEQ ID NO: 31261
  Payload ID: 6137
  Gene Symbol: FCAR
  Gene Name: Fc fragment of IgA receptor
  Uniprot ID: P24071
  ENSP ID: ENSP00000478634

SEQ ID NO: 31279 - protein, 227 aa, Homo sapiens; identical to SEQ ID NO: 31261
  Payload ID: 6137
  Gene Symbol: FCAR
  Gene Name: Fc fragment of IgA receptor
  Uniprot ID: P24071
  ENSP ID: ENSP00000479039

SEQ ID NO: 31280 - protein, 253 aa, Homo sapiens; identical to SEQ ID NO: 31257
  Payload ID: 6137
  Gene Symbol: FCAR
  Gene Name: Fc fragment of IgA receptor
  Uniprot ID: P24071
  ENSP ID: ENSP00000479099

SEQ ID NO: 31281 - protein, 239 aa, Homo sapiens; identical to SEQ ID NO: 31260
  Payload ID: 6137
  Gene Symbol: FCAR
  Gene Name: Fc fragment of IgA receptor
  Uniprot ID: P24071
  ENSP ID: ENSP00000479230

SEQ ID NO: 31282 - protein, 191 aa, Homo sapiens; identical to SEQ ID NO: 31253
  Payload ID: 6137
  Gene Symbol: FCAR
  Gene Name: Fc fragment of IgA receptor
  Uniprot ID: P24071
  ENSP ID: ENSP00000479239

SEQ ID NO: 31283 - protein, 209 aa, Homo sapiens; identical to SEQ ID NO: 31256
  Payload ID: 6137
  Gene Symbol: FCAR
  Gene Name: Fc fragment of IgA receptor
  Uniprot ID: P24071
  ENSP ID: ENSP00000479360

SEQ ID NO: 31284 - protein, 239 aa, Homo sapiens; identical to SEQ ID NO: 31260
  Payload ID: 6137
  Gene Symbol: FCAR
  Gene Name: Fc fragment of IgA receptor
  Uniprot ID: P24071
  ENSP ID: ENSP00000479688

SEQ ID NO: 31285 - protein, 287 aa, Homo sapiens; identical to SEQ ID NO: 31254
  Payload ID: 6137
  Gene Symbol: FCAR
  Gene Name: Fc fragment of IgA receptor
  Uniprot ID: P24071
  ENSP ID: ENSP00000479738

SEQ ID NO: 31286 - protein, 209 aa, Homo sapiens; identical to SEQ ID NO: 31256
  Payload ID: 6137
  Gene Symbol: FCAR
  Gene Name: Fc fragment of IgA receptor
  Uniprot ID: P24071
  ENSP ID: ENSP00000479792

SEQ ID NO: 31287 - protein, 265 aa, Homo sapiens; identical to SEQ ID NO: 31258
  Payload ID: 6137
  Gene Symbol: FCAR
  Gene Name: Fc fragment of IgA receptor
  Uniprot ID: P24071
  ENSP ID: ENSP00000479831

SEQ ID NO: 31288 - protein, 239 aa, Homo sapiens; identical to SEQ ID NO: 31260
  Payload ID: 6137
  Gene Symbol: FCAR
  Gene Name: Fc fragment of IgA receptor
  Uniprot ID: P24071
  ENSP ID: ENSP00000479880

SEQ ID NO: 31289 - protein, 179 aa, Homo sapiens; identical to SEQ ID NO: 31259
  Payload ID: 6137
  Gene Symbol: FCAR
  Gene Name: Fc fragment of IgA receptor
  Uniprot ID: P24071
  ENSP ID: ENSP00000479924

SEQ ID NO: 31290 - protein, 227 aa, Homo sapiens; identical to SEQ ID NO: 31261
  Payload ID: 6137
  Gene Symbol: FCAR
  Gene Name: Fc fragment of IgA receptor
  Uniprot ID: P24071
  ENSP ID: ENSP00000480013

SEQ ID NO: 31291 - protein, 227 aa, Homo sapiens; identical to SEQ ID NO: 31261
  Payload ID: 6137
  Gene Symbol: FCAR
  Gene Name: Fc fragment of IgA receptor
  Uniprot ID: P24071
  ENSP ID: ENSP00000480323

SEQ ID NO: 31292 - protein, 178 aa, Homo sapiens; identical to SEQ ID NO: 31252
  Payload ID: 6137
  Gene Symbol: FCAR
  Gene Name: Fc fragment of IgA receptor
  Uniprot ID: P24071
  ENSP ID: ENSP00000480406

SEQ ID NO: 31293 - protein, 253 aa, Homo sapiens; identical to SEQ ID NO: 31257
  Payload ID: 6137
  Gene Symbol: FCAR
  Gene Name: Fc fragment of IgA receptor
  Uniprot ID: P24071
  ENSP ID: ENSP00000480444

SEQ ID NO: 31294 - protein, 227 aa, Homo sapiens; identical to SEQ ID NO: 31261
  Payload ID: 6137
  Gene Symbol: FCAR
  Gene Name: Fc fragment of IgA receptor
  Uniprot ID: P24071
  ENSP ID: ENSP00000480461

SEQ ID NO: 31295 - protein, 275 aa, Homo sapiens; identical to SEQ ID NO: 31255
  Payload ID: 6137
  Gene Symbol: FCAR
  Gene Name: Fc fragment of IgA receptor
  Uniprot ID: P24071
  ENSP ID: ENSP00000480496

SEQ ID NO: 31296 - protein, 191 aa, Homo sapiens; identical to SEQ ID NO: 31253
  Payload ID: 6137
  Gene Symbol: FCAR
  Gene Name: Fc fragment of IgA receptor
  Uniprot ID: P24071
  ENSP ID: ENSP00000480498

SEQ ID NO: 31297 - protein, 265 aa, Homo sapiens; identical to SEQ ID NO: 31258
  Payload ID: 6137
  Gene Symbol: FCAR
  Gene Name: Fc fragment of IgA receptor
  Uniprot ID: P24071
  ENSP ID: ENSP00000480748

SEQ ID NO: 31298 - protein, 191 aa, Homo sapiens; identical to SEQ ID NO: 31253
  Payload ID: 6137
  Gene Symbol: FCAR
  Gene Name: Fc fragment of IgA receptor
  Uniprot ID: P24071
  ENSP ID: ENSP00000480965

SEQ ID NO: 31299 - protein, 179 aa, Homo sapiens; identical to SEQ ID NO: 31259
  Payload ID: 6137
  Gene Symbol: FCAR
  Gene Name: Fc fragment of IgA receptor
  Uniprot ID: P24071
  ENSP ID: ENSP00000480970

SEQ ID NO: 31300 - protein, 191 aa, Homo sapiens; identical to SEQ ID NO: 31253
  Payload ID: 6137
  Gene Symbol: FCAR
  Gene Name: Fc fragment of IgA receptor
  Uniprot ID: P24071
  ENSP ID: ENSP00000481129

SEQ ID NO: 31301 - protein, 287 aa, Homo sapiens; identical to SEQ ID NO: 31254
  Payload ID: 6137
  Gene Symbol: FCAR
  Gene Name: Fc fragment of IgA receptor
  Uniprot ID: P24071
  ENSP ID: ENSP00000481195

SEQ ID NO: 31302 - protein, 253 aa, Homo sapiens; identical to SEQ ID NO: 31257
  Payload ID: 6137
  Gene Symbol: FCAR
  Gene Name: Fc fragment of IgA receptor
  Uniprot ID: P24071
  ENSP ID: ENSP00000481230

SEQ ID NO: 31303 - protein, 275 aa, Homo sapiens; identical to SEQ ID NO: 31255
  Payload ID: 6137
  Gene Symbol: FCAR
  Gene Name: Fc fragment of IgA receptor
  Uniprot ID: P24071
  ENSP ID: ENSP00000481345

SEQ ID NO: 31304 - protein, 227 aa, Homo sapiens; identical to SEQ ID NO: 31261
  Payload ID: 6137
  Gene Symbol: FCAR
  Gene Name: Fc fragment of IgA receptor
  Uniprot ID: P24071
  ENSP ID: ENSP00000481366

SEQ ID NO: 31305 - protein, 275 aa, Homo sapiens
  Payload ID: 6137
  Gene Symbol: FCAR
  Gene Name: Fc fragment of IgA receptor
  ENSP ID: ENSP00000481387
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSNTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 31306 - protein, 275 aa, Homo sapiens; identical to SEQ ID NO: 31255
  Payload ID: 6137
  Gene Symbol: FCAR
  Gene Name: Fc fragment of IgA receptor
  Uniprot ID: P24071
  ENSP ID: ENSP00000481394

SEQ ID NO: 31307 - protein, 287 aa, Homo sapiens; identical to SEQ ID NO: 31254
  Payload ID: 6137
  Gene Symbol: FCAR
  Gene Name: Fc fragment of IgA receptor
  Uniprot ID: P24071
  ENSP ID: ENSP00000481502

SEQ ID NO: 31308 - protein, 239 aa, Homo sapiens; identical to SEQ ID NO: 31260
  Payload ID: 6137
  Gene Symbol: FCAR
  Gene Name: Fc fragment of IgA receptor
  Uniprot ID: P24071
  ENSP ID: ENSP00000481560

SEQ ID NO: 31309 - protein, 275 aa, Homo sapiens; identical to SEQ ID NO: 31255
  Payload ID: 6137
  Gene Symbol: FCAR
  Gene Name: Fc fragment of IgA receptor
  Uniprot ID: P24071
  ENSP ID: ENSP00000481668

SEQ ID NO: 31310 - protein, 275 aa, Homo sapiens; identical to SEQ ID NO: 31255
  Payload ID: 6137
  Gene Symbol: FCAR
  Gene Name: Fc fragment of IgA receptor
  Uniprot ID: P24071
  ENSP ID: ENSP00000481676

SEQ ID NO: 31311 - protein, 142 aa, Homo sapiens; identical to SEQ ID NO: 31277
  Payload ID: 6137
  Gene Symbol: FCAR
  Gene Name: Fc fragment of IgA receptor
  ENSP ID: ENSP00000481767

SEQ ID NO: 31312 - protein, 239 aa, Homo sapiens
  Payload ID: 6137
  Gene Symbol: FCAR
  Gene Name: Fc fragment of IgA receptor
  ENSP ID: ENSP00000481983
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSNTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 31313 - protein, 265 aa, Homo sapiens; identical to SEQ ID NO: 31258
  Payload ID: 6137
  Gene Symbol: FCAR
  Gene Name: Fc fragment of IgA receptor
  Uniprot ID: P24071
  ENSP ID: ENSP00000481985

SEQ ID NO: 31314 - protein, 253 aa, Homo sapiens; identical to SEQ ID NO: 31257
  Payload ID: 6137
  Gene Symbol: FCAR
  Gene Name: Fc fragment of IgA receptor
  Uniprot ID: P24071
  ENSP ID: ENSP00000482022

SEQ ID NO: 31315 - protein, 191 aa, Homo sapiens; identical to SEQ ID NO: 31253
  Payload ID: 6137
  Gene Symbol: FCAR
  Gene Name: Fc fragment of IgA receptor
  Uniprot ID: P24071
  ENSP ID: ENSP00000482025

SEQ ID NO: 31316 - protein, 191 aa, Homo sapiens; identical to SEQ ID NO: 31253
  Payload ID: 6137
  Gene Symbol: FCAR
  Gene Name: Fc fragment of IgA receptor
  Uniprot ID: P24071
  ENSP ID: ENSP00000482056

SEQ ID NO: 31317 - protein, 239 aa, Homo sapiens; identical to SEQ ID NO: 31260
  Payload ID: 6137
  Gene Symbol: FCAR
  Gene Name: Fc fragment of IgA receptor
  Uniprot ID: P24071
  ENSP ID: ENSP00000482108

SEQ ID NO: 31318 - protein, 265 aa, Homo sapiens; identical to SEQ ID NO: 31258
  Payload ID: 6137
  Gene Symbol: FCAR
  Gene Name: Fc fragment of IgA receptor
  Uniprot ID: P24071
  ENSP ID: ENSP00000482273

SEQ ID NO: 31319 - protein, 287 aa, Homo sapiens; identical to SEQ ID NO: 31254
  Payload ID: 6137
  Gene Symbol: FCAR
  Gene Name: Fc fragment of IgA receptor
  Uniprot ID: P24071
  ENSP ID: ENSP00000482334

SEQ ID NO: 31320 - protein, 179 aa, Homo sapiens; identical to SEQ ID NO: 31259
  Payload ID: 6137
  Gene Symbol: FCAR
  Gene Name: Fc fragment of IgA receptor
  Uniprot ID: P24071
  ENSP ID: ENSP00000482451

SEQ ID NO: 31321 - protein, 178 aa, Homo sapiens; identical to SEQ ID NO: 31252
  Payload ID: 6137
  Gene Symbol: FCAR
  Gene Name: Fc fragment of IgA receptor
  Uniprot ID: P24071
  ENSP ID: ENSP00000482518

SEQ ID NO: 31322 - protein, 227 aa, Homo sapiens
  Payload ID: 6137
  Gene Symbol: FCAR
  Gene Name: Fc fragment of IgA receptor
  ENSP ID: ENSP00000482539
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSNTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 31323 - protein, 287 aa, Homo sapiens; identical to SEQ ID NO: 31254
  Payload ID: 6137
  Gene Symbol: FCAR
  Gene Name: Fc fragment of IgA receptor
  Uniprot ID: P24071
  ENSP ID: ENSP00000482623

SEQ ID NO: 31324 - protein, 179 aa, Homo sapiens; identical to SEQ ID NO: 31259
  Payload ID: 6137
  Gene Symbol: FCAR
  Gene Name: Fc fragment of IgA receptor
  Uniprot ID: P24071
  ENSP ID: ENSP00000482670

SEQ ID NO: 31325 - protein, 179 aa, Homo sapiens; identical to SEQ ID NO: 31259
  Payload ID: 6137
  Gene Symbol: FCAR
  Gene Name: Fc fragment of IgA receptor
  Uniprot ID: P24071
  ENSP ID: ENSP00000482741

SEQ ID NO: 31326 - protein, 287 aa, Homo sapiens; identical to SEQ ID NO: 31254
  Payload ID: 6137
  Gene Symbol: FCAR
  Gene Name: Fc fragment of IgA receptor
  Uniprot ID: P24071
  ENSP ID: ENSP00000482807

SEQ ID NO: 31327 - protein, 275 aa, Homo sapiens; identical to SEQ ID NO: 31255
  Payload ID: 6137
  Gene Symbol: FCAR
  Gene Name: Fc fragment of IgA receptor
  Uniprot ID: P24071
  ENSP ID: ENSP00000482976

SEQ ID NO: 31328 - protein, 287 aa, Homo sapiens; identical to SEQ ID NO: 31254
  Payload ID: 6137
  Gene Symbol: FCAR
  Gene Name: Fc fragment of IgA receptor
  Uniprot ID: P24071
  ENSP ID: ENSP00000483099

SEQ ID NO: 31329 - protein, 209 aa, Homo sapiens; identical to SEQ ID NO: 31256
  Payload ID: 6137
  Gene Symbol: FCAR
  Gene Name: Fc fragment of IgA receptor
  Uniprot ID: P24071
  ENSP ID: ENSP00000483121

SEQ ID NO: 31330 - protein, 265 aa, Homo sapiens; identical to SEQ ID NO: 31258
  Payload ID: 6137
  Gene Symbol: FCAR
  Gene Name: Fc fragment of IgA receptor
  Uniprot ID: P24071
  ENSP ID: ENSP00000483250

SEQ ID NO: 31331 - protein, 253 aa, Homo sapiens; identical to SEQ ID NO: 31257
  Payload ID: 6137
  Gene Symbol: FCAR
  Gene Name: Fc fragment of IgA receptor
  Uniprot ID: P24071
  ENSP ID: ENSP00000483258

SEQ ID NO: 31332 - protein, 178 aa, Homo sapiens; identical to SEQ ID NO: 31252
  Payload ID: 6137
  Gene Symbol: FCAR
  Gene Name: Fc fragment of IgA receptor
  Uniprot ID: P24071
  ENSP ID: ENSP00000483327

SEQ ID NO: 31333 - protein, 191 aa, Homo sapiens; identical to SEQ ID NO: 31253
  Payload ID: 6137
  Gene Symbol: FCAR
  Gene Name: Fc fragment of IgA receptor
  Uniprot ID: P24071
  ENSP ID: ENSP00000483402

SEQ ID NO: 31334 - protein, 239 aa, Homo sapiens; identical to SEQ ID NO: 31260
  Payload ID: 6137
  Gene Symbol: FCAR
  Gene Name: Fc fragment of IgA receptor
  Uniprot ID: P24071
  ENSP ID: ENSP00000483437

SEQ ID NO: 31335 - protein, 179 aa, Homo sapiens; identical to SEQ ID NO: 31259
  Payload ID: 6137
  Gene Symbol: FCAR
  Gene Name: Fc fragment of IgA receptor
  Uniprot ID: P24071
  ENSP ID: ENSP00000483472

SEQ ID NO: 31336 - protein, 209 aa, Homo sapiens; identical to SEQ ID NO: 31256
  Payload ID: 6137
  Gene Symbol: FCAR
  Gene Name: Fc fragment of IgA receptor
  Uniprot ID: P24071
  ENSP ID: ENSP00000483503

SEQ ID NO: 31337 - protein, 239 aa, Homo sapiens; identical to SEQ ID NO: 31260
  Payload ID: 6137
  Gene Symbol: FCAR
  Gene Name: Fc fragment of IgA receptor
  Uniprot ID: P24071
  ENSP ID: ENSP00000483841

SEQ ID NO: 31338 - protein, 191 aa, Homo sapiens
  Payload ID: 6137
  Gene Symbol: FCAR
  Gene Name: Fc fragment of IgA receptor
  ENSP ID: ENSP00000484050
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSNTLELVVTDSIHQDYTTQNLIRMAVAGLVLVALLAILVENWHSHTALNKEASADVAEPSWSQQMCQPGLTFARTPSVCK

SEQ ID NO: 31339 - protein, 227 aa, Homo sapiens; identical to SEQ ID NO: 31261
  Payload ID: 6137
  Gene Symbol: FCAR
  Gene Name: Fc fragment of IgA receptor
  Uniprot ID: P24071
  ENSP ID: ENSP00000484136

SEQ ID NO: 31340 - protein, 178 aa, Homo sapiens; identical to SEQ ID NO: 31252
  Payload ID: 6137
  Gene Symbol: FCAR
  Gene Name: Fc fragment of IgA receptor
  Uniprot ID: P24071
  ENSP ID: ENSP00000484141

SEQ ID NO: 31341 - protein, 178 aa, Homo sapiens; identical to SEQ ID NO: 31252
  Payload ID: 6137
  Gene Symbol: FCAR
  Gene Name: Fc fragment of IgA receptor
  Uniprot ID: P24071
  ENSP ID: ENSP00000484272

SEQ ID NO: 31342 - protein, 265 aa, Homo sapiens; identical to SEQ ID NO: 31258
  Payload ID: 6137
  Gene Symbol: FCAR
  Gene Name: Fc fragment of IgA receptor
  Uniprot ID: P24071
  ENSP ID: ENSP00000484276

SEQ ID NO: 31343 - protein, 253 aa, Homo sapiens; identical to SEQ ID NO: 31257
  Payload ID: 6137
  Gene Symbol: FCAR
  Gene Name: Fc fragment of IgA receptor
  Uniprot ID: P24071
  ENSP ID: ENSP00000484483

SEQ ID NO: 31344 - protein, 117 aa, Homo sapiens
  Payload ID: 6137
  Gene Symbol: FCAR
  Gene Name: Fc fragment of IgA receptor
  ENSP ID: ENSP00000484589
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTT

SEQ ID NO: 31345 - protein, 265 aa, Homo sapiens
  Payload ID: 6137
  Gene Symbol: FCAR
  Gene Name: Fc fragment of IgA receptor
  ENSP ID: ENSP00000484613
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSNTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 31346 - protein, 179 aa, Homo sapiens; identical to SEQ ID NO: 31259
  Payload ID: 6137
  Gene Symbol: FCAR
  Gene Name: Fc fragment of IgA receptor
  Uniprot ID: P24071
  ENSP ID: ENSP00000484662

SEQ ID NO: 31347 - protein, 178 aa, Homo sapiens; identical to SEQ ID NO: 31252
  Payload ID: 6137
  Gene Symbol: FCAR
  Gene Name: Fc fragment of IgA receptor
  Uniprot ID: P24071
  ENSP ID: ENSP00000484741

SEQ ID NO: 31348 - protein, 275 aa, Homo sapiens; identical to SEQ ID NO: 31255
  Payload ID: 6137
  Gene Symbol: FCAR
  Gene Name: Fc fragment of IgA receptor
  Uniprot ID: P24071
  ENSP ID: ENSP00000484816

SEQ ID NO: 31349 - protein, 239 aa, Homo sapiens; identical to SEQ ID NO: 31260
  Payload ID: 6137
  Gene Symbol: FCAR
  Gene Name: Fc fragment of IgA receptor
  Uniprot ID: P24071
  ENSP ID: ENSP00000484868

SEQ ID NO: 31350 - protein, 178 aa, Homo sapiens; identical to SEQ ID NO: 31252
  Payload ID: 6137
  Gene Symbol: FCAR
  Gene Name: Fc fragment of IgA receptor
  Uniprot ID: P24071
  ENSP ID: ENSP00000484906

SEQ ID NO: 31351 - protein, 253 aa, Homo sapiens; identical to SEQ ID NO: 31257
  Payload ID: 6137
  Gene Symbol: FCAR
  Gene Name: Fc fragment of IgA receptor
  Uniprot ID: P24071
  ENSP ID: ENSP00000484917

SEQ ID NO: 31352 - protein, 224 aa, Homo sapiens
  Payload ID: 6138
  Gene Symbol: FCER1A
  Gene Name: Fc fragment of IgE, high affinity I, receptor for
  alpha polypeptide
  ENSP ID: ENSP00000357096
MAPAMESPTLLCVALLFFAPDGVLAVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 31353 - protein, 257 aa, Homo sapiens
  Payload ID: 6138
  Gene Symbol: FCER1A
  Gene Name: Fc fragment of IgE, high affinity I, receptor for
  alpha polypeptide
  Uniprot ID: P12319
  ENSP ID: ENSP00000357097
MAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 31354 - protein, 86 aa, Homo sapiens
  Payload ID: 6139
  Gene Symbol: FCER1G
  Gene Name: Fc fragment of IgE, high affinity I, receptor for
  gamma polypeptide
  Uniprot ID: P30273
  ENSP ID: ENSP00000289902
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 31355 - protein, 112 aa, Homo sapiens
  Payload ID: 6139
  Gene Symbol: FCER1G
  Gene Name: Fc fragment of IgE, high affinity I, receptor for
  gamma polypeptide
  ENSP ID: ENSP00000356971
MIPAVVLLLLLLVEQAAALGEPQLCYILDAILFLYGIVLTLLYCRLKIQVRKAAITSYEKSDGVYTMESPSITRLECSGMIWAHCNLCLLGSRDSRASPSRVAKTTGTTMPS

SEQ ID NO: 31356 - protein, 321 aa, Homo sapiens
  Payload ID: 6140
  Gene Symbol: FCER2
  Gene Name: Fc fragment of IgE, low affinity II, receptor for (CD23)
  Uniprot ID: P06734
  ENSP ID: ENSP00000264072
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 31357 - protein, 320 aa, Homo sapiens
  Payload ID: 6140
  Gene Symbol: FCER2
  Gene Name: Fc fragment of IgE, low affinity II, receptor for (CD23)
  ENSP ID: ENSP00000353178
MNPPSQEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 31358 - protein, 321 aa, Homo sapiens; identical to SEQ ID NO: 31356
  Payload ID: 6140
  Gene Symbol: FCER2
  Gene Name: Fc fragment of IgE, low affinity II, receptor for (CD23)
  Uniprot ID: P06734
  ENSP ID: ENSP00000471974

SEQ ID NO: 31359 - protein, 159 aa, Homo sapiens
  Payload ID: 6140
  Gene Symbol: FCER2
  Gene Name: Fc fragment of IgE, low affinity II, receptor for (CD23)
  ENSP ID: ENSP00000472067
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQELNERNEASDLLERLREEVTKLRMELQVSSGFVCNTCPEKWINFQRKCYYFGKG

SEQ ID NO: 31360 - protein, 1642 aa, Homo sapiens
  Payload ID: 6141
  Gene Symbol: FCGBP
  Gene Name: Fc fragment of IgG binding protein
  ENSP ID: ENSP00000479036
CPPHSHYEACSYGCPLSCGDLPVPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVSDSPCLPPPTCPPGSEGCIPSEECPPELEKKYQKEEFCGLLSSPTGPLSSCHKLVDPQGPLKDCIFDLCLGGGNLSILCSNIHAYVSACQVAGGHVEPWRNETFCPMECPQNSHYELCADTCSLGCSALSAPLQCPDGCAEGCQCDSGFLYNGQACVPIQQCGCYHNGAYYEPEQTVLIDNCRQQCTCHAGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSAGCIPSDKCPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNG

SEQ ID NO: 31361 - protein, 4204 aa, Homo sapiens
  Payload ID: 6141
  Gene Symbol: FCGBP
  Gene Name: Fc fragment of IgG binding protein
  ENSP ID: ENSP00000481056
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVSDSPCLPPPTCPPGSEGCIPSEECPPELEKKYQKEEFCGLLSSPTGPLSSCHKLVDPQGPLKDCIFDLCLGGGNLSILCSNIHAYVSACQVAGGHVEPWRNETFCPMECPQNSHYELCADTCSLGCSALSAPLQCPDGCAEGCQCDSGFLYNGQACVPIQQCGCYHNGAYYEPEQTVLIDNCRQQCTCHAGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSAGCIPSDKCPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNGQACVPIQQCGCYHNGVYYEPEQTVLIDNCRQQCTCHVGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLSSGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVALPFQLDSLLHAHLSGADVVVTTTSGLSLAFDGDSFVRLRVPAAYAASLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLGEWRRPDFCPLQCPAHSHYELCGDSCPVSCPSLSAPEGCESACREGCVCDAGFVLSGDTCVPVGQCGCLHDGRYYPLGEVFYPGPECERRCECGPGGHVTCQEGAACGPHEECRLEDGVQACHATGCGRCLANGGIHYITLDGRVYDLHGSCSYVLAQVCHPKPGDEDFSIVLEKNAAGDLQRLLVTVAGQVVSLAQGQQVTVDGEAVALPVAVGRVRVTAEGRNMVLQTTKGLRLLFDGDAHLLMSIPSPFRGRLCGLCGNFNGNWSDDFVLPNGSAASSVETFGAAWRAPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 31362 - protein, 374 aa, Homo sapiens
  Payload ID: 6142
  Gene Symbol: FCGR1A
  Gene Name: Fc fragment of IgG, high affinity Ia, receptor (CD64)
  Uniprot ID: P12314
  ENSP ID: ENSP00000358165
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 31363 - protein, 240 aa, Homo sapiens
  Payload ID: 6142
  Gene Symbol: FCGR1A
  Gene Name: Fc fragment of IgG, high affinity Ia, receptor (CD64)
  ENSP ID: ENSP00000394279
MWFLTTLLLWGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSG

SEQ ID NO: 31364 - protein, 188 aa, Homo sapiens
  Payload ID: 6143
  Gene Symbol: FCGR1B
  Gene Name: Fc fragment of IgG, high affinity Ib, receptor (CD64)
  Uniprot ID: Q92637
  ENSP ID: ENSP00000358390
MWFLTTLLLWGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 31365 - protein, 280 aa, Homo sapiens
  Payload ID: 6143
  Gene Symbol: FCGR1B
  Gene Name: Fc fragment of IgG, high affinity Ib, receptor (CD64)
  ENSP ID: ENSP00000358391
MWFLTTLLLWVPVDGQVDTTKAVITLQPPWVSVFQEETITLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 31366 - protein, 225 aa, Homo sapiens
  Payload ID: 6143
  Gene Symbol: FCGR1B
  Gene Name: Fc fragment of IgG, high affinity Ib, receptor (CD64)
  ENSP ID: ENSP00000478655
MWFLTTLLLWVPVDGQVVDTTKAVITLQPPWVSVFQEETITLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKELFPAPVLNASVTSPLLEGNLVTLSCETKLLLQRPGL

SEQ ID NO: 31367 - protein, 224 aa, Homo sapiens
  Payload ID: 6143
  Gene Symbol: FCGR1B
  Gene Name: Fc fragment of IgG, high affinity Ib, receptor (CD64)
  ENSP ID: ENSP00000479641
MWFLTTLLLWVPVDGQVDTTKAVITLQPPWVSVFQEETITLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKELFPAPVLNASVTSPLLEGNLVTLSCETKLLLQRPGL

SEQ ID NO: 31368 - protein, 249 aa, Homo sapiens
  Payload ID: 6143
  Gene Symbol: FCGR1B
  Gene Name: Fc fragment of IgG, high affinity Ib, receptor (CD64)
  ENSP ID: ENSP00000481411
MGKWPPWVSVFQEETITLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVH

SEQ ID NO: 31369 - protein, 224 aa, Homo sapiens; identical to SEQ ID NO: 31367
  Payload ID: 6143
  Gene Symbol: FCGR1B
  Gene Name: Fc fragment of IgG, high affinity Ib, receptor (CD64)
  ENSP ID: ENSP00000485498

SEQ ID NO: 31370 - protein, 317 aa, Homo sapiens
  Payload ID: 6144
  Gene Symbol: FCGR2A
  Gene Name: Fc fragment of IgG, low affinity IIa, receptor (CD32)
  Uniprot ID: P12318
  ENSP ID: ENSP00000271450
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 31371 - protein, 316 aa, Homo sapiens
  Payload ID: 6144
  Gene Symbol: FCGR2A
  Gene Name: Fc fragment of IgG, low affinity IIa, receptor (CD32)
  Uniprot ID: P12318
  ENSP ID: ENSP00000356949
MTMETQMSQNVCPRNLWLLQPLTVLLLLASADSQAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 31372 - protein, 136 aa, Homo sapiens
  Payload ID: 6144
  Gene Symbol: FCGR2A
  Gene Name: Fc fragment of IgG, low affinity IIa, receptor (CD32)
  ENSP ID: ENSP00000440148
MTMETQMSQNVCPRNLWLLQPLTVLLLLASADSQAAPPKAVLKLEPPWINVLQEDSVTLTCQGARSPESDSIQWFHNGNLIPTHTQPSYRFKANNNDSGEYTCQTGQTSLSDPVHLTVLSGQWRKAPGWTWEGQDG

SEQ ID NO: 31373 - protein, 137 aa, Homo sapiens
  Payload ID: 6144
  Gene Symbol: FCGR2A
  Gene Name: Fc fragment of IgG, low affinity IIa, receptor (CD32)
  ENSP ID: ENSP00000441156
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSGQWRKAPGWTWEGQDG

SEQ ID NO: 31374 - protein, 86 aa, Homo sapiens
  Payload ID: 6144
  Gene Symbol: FCGR2A
  Gene Name: Fc fragment of IgG, low affinity IIa, receptor (CD32)
  ENSP ID: ENSP00000476411
  MOD_RES (1)..(1): Any amino acid
XSTDPVKAAQFEPPGRQMIAIRKRQLEETNNDYETADGGYMTLNPRAPTDDDKNIYLTLPPNDHVNMQLPEGCDLLREVIPGRLET

SEQ ID NO: 31375 - protein, 190 aa, Homo sapiens
  Payload ID: 6144
  Gene Symbol: FCGR2A
  Gene Name: Fc fragment of IgG, low affinity IIa, receptor (CD32)
  ENSP ID: ENSP00000476495
AAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQAWAALHQWGSLWLWSLRLL

SEQ ID NO: 31376 - protein, 291 aa, Homo sapiens
  Payload ID: 6145
  Gene Symbol: FCGR2B
  Gene Name: Fc fragment of IgG, low affinity IIb, receptor (CD32)
  Uniprot ID: P31994
  ENSP ID: ENSP00000236937
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 31377 - protein, 310 aa, Homo sapiens
  Payload ID: 6145
  Gene Symbol: FCGR2B
  Gene Name: Fc fragment of IgG, low affinity IIb, receptor (CD32)
  Uniprot ID: P31994
  ENSP ID: ENSP00000351497
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 31378 - protein, 303 aa, Homo sapiens
  Payload ID: 6145
  Gene Symbol: FCGR2B
  Gene Name: Fc fragment of IgG, low affinity IIb, receptor (CD32)
  Uniprot ID: P31994
  ENSP ID: ENSP00000356938
MGILSFLPVLATESDWADCKSPQPWGHMLLWTAVLFLAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 31379 - protein, 310 aa, Homo sapiens; identical to SEQ ID NO: 31377
  Payload ID: 6145
  Gene Symbol: FCGR2B
  Gene Name: Fc fragment of IgG, low affinity IIb, receptor (CD32)
  Uniprot ID: P31994
  ENSP ID: ENSP00000404329

SEQ ID NO: 31380 - protein, 322 aa, Homo sapiens
  Payload ID: 6146
  Gene Symbol: FCGR2C
  Gene Name: Fc fragment of IgG, low affinity IIc, receptor for (CD32) (gene/pseudogene)
  ENSP ID: ENSP00000426627
MGILSFLPVLATESDWADCKSPQPWGHMLLWTAVLFLAPVAGTPAAPPKAVLKLEPWINVLQEDSVTLTCRGTHSPESDSIPWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANSTDPVKAAQFEPPGRQMIAIRKRQPEETNNDYETADGGYMTLNPRAPTDDDKNIYLTLPPNDHVNSNN

SEQ ID NO: 31381 - protein, 322 aa, Homo sapiens; identical to SEQ ID NO: 31380
  Payload ID: 6146
  Gene Symbol: FCGR2C
  Gene Name: Fc fragment of IgG, low affinity IIc, receptor for (CD32) (gene/pseudogene)
  ENSP ID: ENSP00000444663

SEQ ID NO: 31382 - protein, 266 aa, Homo sapiens
  Payload ID: 6146
  Gene Symbol: FCGR2C
  Gene Name: Fc fragment of IgG, low affinity IIc, receptor for (CD32) (gene/pseudogene)
  ENSP ID: ENSP00000480953
MGILSFLPVLATESDWADCKSPQPWGHMLLWTAVLFLAPVAGTPAAPPKAVLKLEPWINVLQEDSVTLTCRGTHSPESDSIPWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISATWTSNDCHQKETT

SEQ ID NO: 31383 - protein, 254 aa, Homo sapiens
  Payload ID: 6147
  Gene Symbol: FCGR3A
  Gene Name: Fc fragment of IgG, low affinity IIIa, receptor (CD16a)
  Uniprot ID: P08637
  ENSP ID: ENSP00000356944
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 31384 - protein, 290 aa, Homo sapiens
  Payload ID: 6147
  Gene Symbol: FCGR3A
  Gene Name: Fc fragment of IgG, low affinity IIIa, receptor (CD16a)
  ENSP ID: ENSP00000356946
MGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 31385 - protein, 254 aa, Homo sapiens; identical to SEQ ID NO: 31383
  Payload ID: 6147
  Gene Symbol: FCGR3A
  Gene Name: Fc fragment of IgG, low affinity IIIa, receptor (CD16a)
  Uniprot ID: P08637
  ENSP ID: ENSP00000392047

SEQ ID NO: 31386 - protein, 105 aa, Homo sapiens
  Payload ID: 6147
  Gene Symbol: FCGR3A
  Gene Name: Fc fragment of IgG, low affinity IIIa, receptor (CD16a)
  ENSP ID: ENSP00000396567
MWQLLLPTALLLLVSAGMRTDLPKAVVFLEPQWYRVLEKDSVTLKCQGAYSPEDNSTQWFHNESLISSQASSYFIDAATVDDSGEYRCQTNLSTLSDPVQLEVHI

SEQ ID NO: 31387 - protein, 271 aa, Homo sapiens
  Payload ID: 6147
  Gene Symbol: FCGR3A
  Gene Name: Fc fragment of IgG, low affinity IIIa, receptor (CD16a)
  ENSP ID: ENSP00000410180
  MOD_RES (1)..(1): Any amino acid
XPLGLRISLVTCPLQCGIMWQLLLPTALLLLVSAGMRTDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 31388 - protein, 254 aa, Homo sapiens; identical to SEQ ID NO: 31383
  Payload ID: 6147
  Gene Symbol: FCGR3A
  Gene Name: Fc fragment of IgG, low affinity IIIa, receptor (CD16a)
  Uniprot ID: P08637
  ENSP ID: ENSP00000416607

SEQ ID NO: 31389 - protein, 233 aa, Homo sapiens
  Payload ID: 6148
  Gene Symbol: FCGR3B
  Gene Name: Fc fragment of IgG, low affinity IIIb, receptor (CD16b)
  Uniprot ID: O75015
  ENSP ID: ENSP00000294800
MWQLLLPTALLLLVSAGMRTEDLPKAVVFLEPQWYSVLEKDSVTLKCQGAYSPEDNSTQWFHNENLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 31390 - protein, 233 aa, Homo sapiens; identical to SEQ ID NO: 31389
  Payload ID: 6148
  Gene Symbol: FCGR3B
  Gene Name: Fc fragment of IgG, low affinity IIIb, receptor (CD16b)
  Uniprot ID: O75015
  ENSP ID: ENSP00000356941

SEQ ID NO: 31391 - protein, 254 aa, Homo sapiens
  Payload ID: 6148
  Gene Symbol: FCGR3B
  Gene Name: Fc fragment of IgG, low affinity IIIb, receptor (CD16b)
  ENSP ID: ENSP00000394204
  MOD_RES (1)..(1): Any amino acid
XVGLVPLGLRISLVTCPLQCGIMWQLLLPTALLLLVSAGMRTDLPKAVVFLEPQWYSVLEKDSVTLKCQGAYSPEDNSTQWFHNENLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 31392 - protein, 269 aa, Homo sapiens
  Payload ID: 6148
  Gene Symbol: FCGR3B
  Gene Name: Fc fragment of IgG, low affinity IIIb, receptor (CD16b)
  ENSP ID: ENSP00000433642
MGGGTGERLFTPSCLVGLVPLGLRISLVTCPLQCGIMWQLLLPTALLLLVSAGMRTEDLPKAVVFLEPQWYSVLEKDSVTLKCQGAYSPEDNSTQWFHNENLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 31393 - protein, 104 aa, Homo sapiens
  Payload ID: 6148
  Gene Symbol: FCGR3B
  Gene Name: Fc fragment of IgG, low affinity IIIb, receptor (CD16b)
  ENSP ID: ENSP00000437084
MRTEDLPKAVVFLEPQWYSVLEKDSVTLKCQGAYSPEDNSTQWFHNENLISSQASSYFIDAATVNDSGEYRCQTNLSTLSDPVQLEVHIGWLLLQAPRWVFKEE

SEQ ID NO: 31394 - protein, 130 aa, Homo sapiens
  Payload ID: 6148
  Gene Symbol: FCGR3B
  Gene Name: Fc fragment of IgG, low affinity IIIb, receptor (CD16b)
  ENSP ID: ENSP00000478466
MRTEDLPKAVVFLEPQWYSVLEKDSVTLKCQGAYSPEDNSTQWFHNENLISSQASSYFIDAATVNDSGEYRCQTNLSTLSDPVQLEVHIGLAVSTISSFSPPGYQVSFCLVMVLLFAVDTGLYFSVKTNI

SEQ ID NO: 31395 - protein, 216 aa, Homo sapiens
  Payload ID: 6148
  Gene Symbol: FCGR3B
  Gene Name: Fc fragment of IgG, low affinity IIIb, receptor (CD16b)
  ENSP ID: ENSP00000482838
MRTEDLPKAVVFLEPQWYSVLEKDSVTLKCQGAYSPEDNSTQWFHNENLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 31396 - protein, 365 aa, Homo sapiens
  Payload ID: 6149
  Gene Symbol: FCGRT
  Gene Name: Fc fragment of IgG, receptor, transporter, alpha
  Uniprot ID: P55899
  ENSP ID: ENSP00000221466
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 31397 - protein, 365 aa, Homo sapiens; identical to SEQ ID NO: 31396
  Payload ID: 6149
  Gene Symbol: FCGRT
  Gene Name: Fc fragment of IgG, receptor, transporter, alpha
  Uniprot ID: P55899
  ENSP ID: ENSP00000410798

SEQ ID NO: 31398 - protein, 167 aa, Homo sapiens
  Payload ID: 6149
  Gene Symbol: FCGRT
  Gene Name: Fc fragment of IgG, receptor, transporter, alpha
  ENSP ID: ENSP00000469933
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQ

SEQ ID NO: 31399 - protein, 225 aa, Homo sapiens
  Payload ID: 6149
  Gene Symbol: FCGRT
  Gene Name: Fc fragment of IgG, receptor, transporter, alpha
  ENSP ID: ENSP00000469968
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKDTVSHYVAQAGLELLGSSDSPALVS

SEQ ID NO: 31400 - protein, 273 aa, Homo sapiens
  Payload ID: 6149
  Gene Symbol: FCGRT
  Gene Name: Fc fragment of IgG, receptor, transporter, alpha
  ENSP ID: ENSP00000471118
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 31401 - protein, 153 aa, Homo sapiens
  Payload ID: 6149
  Gene Symbol: FCGRT
  Gene Name: Fc fragment of IgG, receptor, transporter, alpha
  ENSP ID: ENSP00000471232
WEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKAPWISLRGDDTGVLLPTPGEAQDADLKDVNVIPATA

SEQ ID NO: 31402 - protein, 99 aa, Homo sapiens
  Payload ID: 6149
  Gene Symbol: FCGRT
  Gene Name: Fc fragment of IgG, receptor, transporter, alpha
  ENSP ID: ENSP00000471300
MGVPRPQPWALGLLLFLLPGSLGAESPAKSSVLVVGIVIGVLLLTAAAVGGALLWRRMRSGLPAPWISLRGDDTGVLLPTPGEAQDADLKDVNVIPATA

SEQ ID NO: 31403 - protein, 189 aa, Homo sapiens
  Payload ID: 6149
  Gene Symbol: FCGRT
  Gene Name: Fc fragment of IgG, receptor, transporter, alpha
  ENSP ID: ENSP00000472256
  MOD_RES (1)..(1): Any amino acid
XSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKAPSPSTLRSCNFGSCGMGWPLAPAR

SEQ ID NO: 31404 - protein, 141 aa, Homo sapiens
  Payload ID: 6149
  Gene Symbol: FCGRT
  Gene Name: Fc fragment of IgG, receptor, transporter, alpha
  ENSP ID: ENSP00000472350
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFM

SEQ ID NO: 31405 - protein, 211 aa, Homo sapiens
  Payload ID: 6149
  Gene Symbol: FCGRT
  Gene Name: Fc fragment of IgG, receptor, transporter, alpha
  ENSP ID: ENSP00000472604
GVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPKARQIFCAWI

SEQ ID NO: 31406 - protein, 38 aa, Homo sapiens
  Payload ID: 6149
  Gene Symbol: FCGRT
  Gene Name: Fc fragment of IgG, receptor, transporter, alpha
  ENSP ID: ENSP00000472794
MNFDLKQGTWGGDWPEALAISQRWQQQDKAANKELTFL

SEQ ID NO: 31407 - protein, 390 aa, Homo sapiens
  Payload ID: 6150
  Gene Symbol: FCMR
  Gene Name: Fc fragment of IgM receptor
  Uniprot ID: O60667
  ENSP ID: ENSP00000356058
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 31408 - protein, 278 aa, Homo sapiens
  Payload ID: 6150
  Gene Symbol: FCMR
  Gene Name: Fc fragment of IgM receptor
  Uniprot ID: O60667
  ENSP ID: ENSP00000404136
MDFWLWPLYFLPEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 31409 - protein, 151 aa, Homo sapiens
  Payload ID: 6150
  Gene Symbol: FCMR
  Gene Name: Fc fragment of IgM receptor
  ENSP ID: ENSP00000432936
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMP

SEQ ID NO: 31410 - protein, 141 aa, Homo sapiens
  Payload ID: 6150
  Gene Symbol: FCMR
  Gene Name: Fc fragment of IgM receptor
  ENSP ID: ENSP00000436316
MDFWLWPLYFLPEMESCCVAQDGLELVALSDPPGSASQSAGITVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNT

SEQ ID NO: 31411 - protein, 125 aa, Homo sapiens
  Payload ID: 6150
  Gene Symbol: FCMR
  Gene Name: Fc fragment of IgM receptor
  ENSP ID: ENSP00000436799
MDFWLWPLYFLPVSGALRILPEVKVEGELGGSVTIKCPLPEMHVRIYLCREMAGSGTCGTVVSTTNFIKAEYKGRVTLKQYPRKNLFLVENTSHHGKSSQCLRLQNGFICPICSRCLHMPVLPNS

SEQ ID NO: 31412 - protein, 147 aa, Homo sapiens
  Payload ID: 6150
  Gene Symbol: FCMR
  Gene Name: Fc fragment of IgM receptor
  ENSP ID: ENSP00000437331
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYL

SEQ ID NO: 31413 - protein, 306 aa, Homo sapiens
  Payload ID: 6150
  Gene Symbol: FCMR
  Gene Name: Fc fragment of IgM receptor
  Uniprot ID: O60667
  ENSP ID: ENSP00000485739
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQSPLQAGPPTGREDARPGELPEAPRVAATALPKQHLQRLPAARSWSGRCRHRGGPRSRPRSAVAPRPAAGV

SEQ ID NO: 31414 - protein, 577 aa, Homo sapiens
  Payload ID: 6151
  Gene Symbol: FCAMR
  Gene Name: Fc receptor, IgA, IgM, high affinity
  ENSP ID: ENSP00000316491
MDGEATVKPGEQKEVVRRGREVDYSRLIAGTLPQSHVTSRRAGWKMPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWILGTPAADVWTSMEAASGEGSAAGDLDAATGDRGPQATLSQTPAVGPWGPPGKESSVKRTFPEDESSSRTLAPVSTMLALFMLMALVLLQRKLWRRRTSQEAERVTLIQMTHFLEVNPQADQLPHVERKMLQDDSLPAGASLTAPERNPGP

SEQ ID NO: 31415 - protein, 50 aa, Homo sapiens
  Payload ID: 6151
  Gene Symbol: FCAMR
  Gene Name: Fc receptor, IgA, IgM, high affinity
  ENSP ID: ENSP00000317155
MDGEATVKPGEQKPPIKADNSLETFYLILLLPHCPTEPAFLPEAQRLLHR

SEQ ID NO: 31416 - protein, 265 aa, Homo sapiens
  Payload ID: 6151
  Gene Symbol: FCAMR
  Gene Name: Fc receptor, IgA, IgM, high affinity
  Uniprot ID: Q8WWV6
  ENSP ID: ENSP00000383746
MDGEATVKPGEQKEVVRRGREVDYSRLIAGTLPQSHVTSRRAGWKMPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAVLFQKMKAALGPWLLSLPCWPCLCLWLWFYCKGSSGEGGPLRRQKGSP

SEQ ID NO: 31417 - protein, 265 aa, Homo sapiens; identical to SEQ ID NO: 31416
  Payload ID: 6151
  Gene Symbol: FCAMR
  Gene Name: Fc receptor, IgA, IgM, high affinity
  Uniprot ID: Q8WWV6
  ENSP ID: ENSP00000392707

SEQ ID NO: 31418 - protein, 366 aa, Homo sapiens
  Payload ID: 6152
  Gene Symbol: FCRL1
  Gene Name: Fc receptor-like 1
  Uniprot ID: Q96LA6
  ENSP ID: ENSP00000351039
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTGRRSARDPLRSLPSPLPQEFTYLNSPTPGQLQPIYENEPREQSVAVHGRQQHSSEQKAQKPWGHIWRTRFP

SEQ ID NO: 31419 - protein, 429 aa, Homo sapiens
  Payload ID: 6152
  Gene Symbol: FCRL1
  Gene Name: Fc receptor-like 1
  Uniprot ID: Q96LA6
  ENSP ID: ENSP00000357158
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 31420 - protein, 428 aa, Homo sapiens
  Payload ID: 6152
  Gene Symbol: FCRL1
  Gene Name: Fc receptor-like 1
  Uniprot ID: Q96LA6
  ENSP ID: ENSP00000418130
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAETLGTHMEDKVSLDIYSRLRKANITDVDYEDAM

SEQ ID NO: 31421 - protein, 508 aa, Homo sapiens
  Payload ID: 6153
  Gene Symbol: FCRL2
  Gene Name: Fc receptor-like 2
  Uniprot ID: Q96LA5
  ENSP ID: ENSP00000355157
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 31422 - protein, 202 aa, Homo sapiens
  Payload ID: 6153
  Gene Symbol: FCRL2
  Gene Name: Fc receptor-like 2
  Uniprot ID: Q96LA5
  ENSP ID: ENSP00000357163
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQGPDGYRRDLMTAGVLWGLFGVLGFTGVALLLYALFHKISGESSATNEPRGASRPNPQEFTYSSPTPDMEELQPVYVNANIRTLLENKDSQVIYSSVKKS

SEQ ID NO: 31423 - protein, 192 aa, Homo sapiens
  Payload ID: 6153
  Gene Symbol: FCRL2
  Gene Name: Fc receptor-like 2
  Uniprot ID: Q96LA5
  ENSP ID: ENSP00000417393
MWEWKICNSHGARPFAEPAGWEFVNLLRHHKSFLIAPLCLSVPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGCIYHLDSPYFAMTFPLLI

SEQ ID NO: 31424 - protein, 734 aa, Homo sapiens
  Payload ID: 6154
  Gene Symbol: FCRL3
  Gene Name: Fc receptor-like 3
  Uniprot ID: Q96P31
  ENSP ID: ENSP00000357167
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 31425 - protein, 742 aa, Homo sapiens
  Payload ID: 6154
  Gene Symbol: FCRL3
  Gene Name: Fc receptor-like 3
  Uniprot ID: Q96P31
  ENSP ID: ENSP00000357169
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENILNPRKNKVQDFPCLCNT

SEQ ID NO: 31426 - protein, 639 aa, Homo sapiens
  Payload ID: 6154
  Gene Symbol: FCRL3
  Gene Name: Fc receptor-like 3
  Uniprot ID: Q96P31
  ENSP ID: ENSP00000433430
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQGVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 31427 - protein, 734 aa, Homo sapiens; identical to SEQ ID NO: 31424
  Payload ID: 6154
  Gene Symbol: FCRL3
  Gene Name: Fc receptor-like 3
  Uniprot ID: Q96P31
  ENSP ID: ENSP00000434331

SEQ ID NO: 31428 - protein, 740 aa, Homo sapiens
  Payload ID: 6154
  Gene Symbol: FCRL3
  Gene Name: Fc receptor-like 3
  Uniprot ID: Q96P31
  ENSP ID: ENSP00000435487
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRTLLSPSVPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 31429 - protein, 256 aa, Homo sapiens
  Payload ID: 6154
  Gene Symbol: FCRL3
  Gene Name: Fc receptor-like 3
  ENSP ID: ENSP00000473680
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSG

SEQ ID NO: 31430 - protein, 515 aa, Homo sapiens
  Payload ID: 6155
  Gene Symbol: FCRL4
  Gene Name: Fc receptor-like 4
  Uniprot ID: Q96PJ5
  ENSP ID: ENSP00000271532
MLLWASLLAFAPVCGQSAAAHKPVISVHPPWTTFFKGERVTLTCNGFQFYATEKTTWYHRHYWGEKLTLTPGNTLEVRESGLYRCQARGSPRSNPVRLLFSSDSLILQAPYSVFEGDTLVLRCHRRRKEKLTAVKYTWNGNILSISNKSWDLLIPQASSNNNGNYRCIGYGDENDVFRSNFKIIKIQELFPHPELKATDSQPTEGNSVNLSCETQLPPERSDTPLHFNFFRDGEVILSDWSTYPELQLPTVWRENSGSYWCGAETVRGNIHKHSPSLQIHVQRIPVSGVLLETQPSGGQAVEGEMLVLVCSVAEGTGDTTFSWHREDMQESLGRKTQRSLRAELELPAIRQSHAGGYYCTADNSYGPVQSMVLNVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEES

SEQ ID NO: 31431 - protein, 977 aa, Homo sapiens
  Payload ID: 6156
  Gene Symbol: FCRL5
  Gene Name: Fc receptor-like 5
  Uniprot ID: Q96RD9
  ENSP ID: ENSP00000354691
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 31432 - protein, 592 aa, Homo sapiens
  Payload ID: 6156
  Gene Symbol: FCRL5
  Gene Name: Fc receptor-like 5
  Uniprot ID: Q96RD9
  ENSP ID: ENSP00000357172
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTGKCWVLASHPPLAEFSLTHSFKNLFALSSFLP

SEQ ID NO: 31433 - protein, 759 aa, Homo sapiens
  Payload ID: 6156
  Gene Symbol: FCRL5
  Gene Name: Fc receptor-like 5
  Uniprot ID: Q96RD9
  ENSP ID: ENSP00000357173
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAGEWALPTSSTSEN

SEQ ID NO: 31434 - protein, 413 aa, Homo sapiens
  Payload ID: 6157
  Gene Symbol: FCRL6
  Gene Name: Fc receptor-like 6
  Uniprot ID: Q6DN72
  ENSP ID: ENSP00000320625
MLPSLGPMLLWTAVLLFVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQELFPPPVLSAIPSPEPREGSLVTLRCQTKLHPLRSALRLLFSFHKDGHTLQDRGPHPELCIPGAKEGDSGLYWCEVAPEGGQVQKQSPQLEVRVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNWLVPWLPASLLGLMVIAAALLVYVRSWRKAGPLPSQIPPTAPGGEQCPLYANVHHQKGKDEGVVYSVVHRTSKRSEARSAEFTVGRKFYHLCGGEMPAAQ

SEQ ID NO: 31435 - protein, 397 aa, Homo sapiens
  Payload ID: 6157
  Gene Symbol: FCRL6
  Gene Name: Fc receptor-like 6
  Uniprot ID: Q6DN72
  ENSP ID: ENSP00000340949
MLLWTAVLLFVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQELFPPPVLSAIPSPEPREGSLVTLRCQTKLHPLRSALRLLFSFHKDGHTLQDRGPHPELCIPGAKEGDSGLYWCEVAPEGGQVQKQSPQLEVRVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNWLVPWLPASLLGLMVIAAALLVYVRSWRKAGPLPSQIPPTAPGGEQCPLYANVHHQKGKDEGVVYSVVHRTSKRSEGQFYHLCGGEMPAAQ

SEQ ID NO: 31436 - protein, 434 aa, Homo sapiens
  Payload ID: 6157
  Gene Symbol: FCRL6
  Gene Name: Fc receptor-like 6
  Uniprot ID: Q6DN72
  ENSP ID: ENSP00000357086
MLLWTAVLLFVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQELFPPPVLSAIPSPEPREGSLVTLRCQTKLHPLRSALRLLFSFHKDGHTLQDRGPHPELCIPGAKEGDSGLYWCEVAPEGGQVQKQSPQLEVRVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNWLVPWLPASLLGLMVIAAALLVYVRSWRKAGPLPSQIPPTAPGGEQCPLYANVHHQKGKDEGVVYSVVHRTSKRSEARSAEFTVGRKDSSIICAEVRCLQPSEVSSTEVNMRSRTLQEPLSDCEEVLC

SEQ ID NO: 31437 - protein, 311 aa, Homo sapiens
  Payload ID: 6157
  Gene Symbol: FCRL6
  Gene Name: Fc receptor-like 6
  Uniprot ID: Q6DN72
  ENSP ID: ENSP00000376068
MLLWTAVLLFVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNWLVPWLPASLLGLMVIAAALLVYVRSWRKAGPLPSQIPPTAPGGEQCPLYANVHHQKGKDEGVVYSVVHRTSKRSEARSAEFTVGRKFYHLCGGEMPAAQ

SEQ ID NO: 31438 - protein, 158 aa, Homo sapiens
  Payload ID: 6157
  Gene Symbol: FCRL6
  Gene Name: Fc receptor-like 6
  ENSP ID: ENSP00000440712
MLPSLVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQELFPPPVLSAIPSPEPREGSLVTLRCQTKLHPLRVARSRSRAPSWRSECRLLYPVLC

SEQ ID NO: 31439 - protein, 376 aa, Homo sapiens
  Payload ID: 6158
  Gene Symbol: FCRLA
  Gene Name: Fc receptor-like A
  Uniprot ID: Q7L513
  ENSP ID: ENSP00000236938
MLKKISVGVAGDLNTVTMKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31440 - protein, 225 aa, Homo sapiens
  Payload ID: 6158
  Gene Symbol: FCRLA
  Gene Name: Fc receptor-like A
  Uniprot ID: Q7L513
  ENSP ID: ENSP00000294796
MKLGCVLMAWALYLSLGVLWVAQMLLAAGCHAELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31441 - protein, 264 aa, Homo sapiens
  Payload ID: 6158
  Gene Symbol: FCRLA
  Gene Name: Fc receptor-like A
  Uniprot ID: Q7L513
  ENSP ID: ENSP00000294798
MKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31442 - protein, 270 aa, Homo sapiens
  Payload ID: 6158
  Gene Symbol: FCRLA
  Gene Name: Fc receptor-like A
  Uniprot ID: Q7L513
  ENSP ID: ENSP00000309596
MKLGCVLMAWALYLSLGVLWVAQMLLAASFETLQCEGPVCTEESSCHTEDDLTDAREAGFQVKAYTFSEPFHLIVSYELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31443 - protein, 141 aa, Homo sapiens
  Payload ID: 6158
  Gene Symbol: FCRLA
  Gene Name: Fc receptor-like A
  Uniprot ID: Q7L513
  ENSP ID: ENSP00000344808
MLKKISVGVAGDLNTVTMKLGCVLMAWALYLSLGVLWVAQMLLGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31444 - protein, 192 aa, Homo sapiens
  Payload ID: 6158
  Gene Symbol: FCRLA
  Gene Name: Fc receptor-like A
  Uniprot ID: Q7L513
  ENSP ID: ENSP00000356926
MLKKISVGVAGDLNTVTMKLGCVLMAWALYLSLGVLWVAQMLLAASFETLQCEGPVCTEESSCHTEDDLTDAREAGFQVKAYTFSEPFHLIVSYGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31445 - protein, 152 aa, Homo sapiens
  Payload ID: 6158
  Gene Symbol: FCRLA
  Gene Name: Fc receptor-like A
  ENSP ID: ENSP00000356927
MLLAASFETLQCEGPVCTEESSCHTEDDLTDAREAGFQVKAYTFSEPFHLIVSYGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31446 - protein, 365 aa, Homo sapiens
  Payload ID: 6158
  Gene Symbol: FCRLA
  Gene Name: Fc receptor-like A
  Uniprot ID: Q7L513
  ENSP ID: ENSP00000356930
MKLGCVLMAWALYLSLGVLWVAQMLLAAGCHAAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31447 - protein, 236 aa, Homo sapiens
  Payload ID: 6158
  Gene Symbol: FCRLA
  Gene Name: Fc receptor-like A
  Uniprot ID: Q7L513
  ENSP ID: ENSP00000356934
MLKKISVGVAGDLNTVTMKLGCVLMAWALYLSLGVLWVAQMLLELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31448 - protein, 382 aa, Homo sapiens
  Payload ID: 6158
  Gene Symbol: FCRLA
  Gene Name: Fc receptor-like A
  Uniprot ID: Q7L513
  ENSP ID: ENSP00000356936
MLKKISVGVAGDLNTVTMKLGCVLMAWALYLSLGVLWVAQMLLAAGCHAAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31449 - protein, 287 aa, Homo sapiens
  Payload ID: 6158
  Gene Symbol: FCRLA
  Gene Name: Fc receptor-like A
  Uniprot ID: Q7L513
  ENSP ID: ENSP00000439838
MLKKISVGVAGDLNTVTMKLGCVLMAWALYLSLGVLWVAQMLLAASFETLQCEGPVCTEESSCHTEDDLTDAREAGFQVKAYTFSEPFHLIVSYELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31450 - protein, 242 aa, Homo sapiens
  Payload ID: 6158
  Gene Symbol: FCRLA
  Gene Name: Fc receptor-like A
  Uniprot ID: Q7L513
  ENSP ID: ENSP00000442870
MLKKISVGVAGDLNTVTMKLGCVLMAWALYLSLGVLWVAQMLLAAGCHAELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 31451 - protein, 275 aa, Homo sapiens
  Payload ID: 6159
  Gene Symbol: FCRLB
  Gene Name: Fc receptor-like B
  Uniprot ID: Q6BAA4
  ENSP ID: ENSP00000338598
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQEARHAAAVRVLQVQPRGAPLRLGRRVHSPGARGRGARIVLVRGGYRHPQCPETQSVAAAPGAGFSPGPGLHHRPSSMGRSLGSW

SEQ ID NO: 31452 - protein, 268 aa, Homo sapiens
  Payload ID: 6159
  Gene Symbol: FCRLB
  Gene Name: Fc receptor-like B
  Uniprot ID: Q6BAA4
  ENSP ID: ENSP00000356921
MWPLTALLLLATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQEARHAAAVRVLQVQPRGAPLRLGRRVHSPGARGRGARIVLVRGGYRHPQCPETQSVAAAPGAGFSPGPGLHHRPSSMGRSLGSW

SEQ ID NO: 31453 - protein, 311 aa, Homo sapiens
  Payload ID: 6159
  Gene Symbol: FCRLB
  Gene Name: Fc receptor-like B
  Uniprot ID: Q6BAA4
  ENSP ID: ENSP00000356922
MWPLTALLLLATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQAARCAASTGAPSTQSRSPRSRSSNRTGARRLPPPAVSGNAVRGCSSRGRVLPWTRPPPPPQLHGPQPWLLVIGRFPSESPRCPDRSRWSPPSGTPPPPGCSSRRAAPRLRGHPPALRRRPWNNRLEP

SEQ ID NO: 31454 - protein, 318 aa, Homo sapiens
  Payload ID: 6159
  Gene Symbol: FCRLB
  Gene Name: Fc receptor-like B
  Uniprot ID: Q6BAA4
  ENSP ID: ENSP00000356923
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQAARCAASTGAPSTQSRSPRSRSSNRTGARRLPPPAVSGNAVRGCSSRGRVLPWTRPPPPPQLHGPQPWLLVIGRFPSESPRCPDRSRWSPPSGTPPPPGCSSRRAAPRLRGHPPALRRRPWNNRLEP

SEQ ID NO: 31455 - protein, 426 aa, Homo sapiens
  Payload ID: 6159
  Gene Symbol: FCRLB
  Gene Name: Fc receptor-like B
  Uniprot ID: Q6BAA4
  ENSP ID: ENSP00000356925
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQELFRAPVLRVMGPREARGAALGGVVLRCDTRLHPQKRDTPLQFAFYKYSRAVRRFDWGAEYTVPEPEVEELESYWCEAATATRSVRKRSPWLQLPGPGSPLDPASTTAPAPWAAALAPGNRPLSFRKPPVSRSVPLVTSVRNTTSTGLQFPASGAPTAGPPACAPPTPLEQSAGALKPDVDLLLREMQLLKGLLSRVVLELKEPQALRELRGTPETPTSHFAVSPGTPETTPVES

SEQ ID NO: 31456 - protein, 198 aa, Homo sapiens
  Payload ID: 6160
  Gene Symbol: FCF1
  Gene Name: FCF1 rRNA-processing protein
  Uniprot ID: Q9Y324
  ENSP ID: ENSP00000344393
MGKQKKTRKYATMKRMLSLRDQRLKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQHKCYIVATVDRDLKRRIRKIPGVPIMYISNHRYNIERMPDDYGAPRF

SEQ ID NO: 31457 - protein, 186 aa, Homo sapiens
  Payload ID: 6160
  Gene Symbol: FCF1
  Gene Name: FCF1 rRNA-processing protein
  ENSP ID: ENSP00000444939
MKRMLSLRDQRLKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQHKCYIVATVDRDLKRRIRKIPGVPIMYISNHRYNIERMPDDYGAPRF

SEQ ID NO: 31458 - protein, 61 aa, Homo sapiens
  Payload ID: 6160
  Gene Symbol: FCF1
  Gene Name: FCF1 rRNA-processing protein
  ENSP ID: ENSP00000450750
MMDCLYAKCIPCITDCVMAEIEKLGQKYRVALRIAKDPRFERLPCTHKGTYADDCLVQRVT

SEQ ID NO: 31459 - protein, 65 aa, Homo sapiens
  Payload ID: 6160
  Gene Symbol: FCF1
  Gene Name: FCF1 rRNA-processing protein
  ENSP ID: ENSP00000451345
MGKQKKTRKYATMKRMLSLRDQRLKEKDRLKPKKKEKKDPSALKEREVWAHLTTSSLIPTLSTFP

SEQ ID NO: 31460 - protein, 40 aa, Homo sapiens
  Payload ID: 6160
  Gene Symbol: FCF1
  Gene Name: FCF1 rRNA-processing protein
  ENSP ID: ENSP00000452297
MKRMLSLRDQRLKEKDRLKPKKKEKKDPSALKEREVIYFQ

SEQ ID NO: 31461 - protein, 52 aa, Homo sapiens
  Payload ID: 6160
  Gene Symbol: FCF1
  Gene Name: FCF1 rRNA-processing protein
  ENSP ID: ENSP00000452415
MGKQKKTRKYATMKRMLSLRDQRLKEKDRLKPKKKEKKDPSALKEREVIYFQ

SEQ ID NO: 31462 - protein, 183 aa, Homo sapiens
  Payload ID: 6160
  Gene Symbol: FCF1
  Gene Name: FCF1 rRNA-processing protein
  ENSP ID: ENSP00000452497
MGKQKKTRNKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQHKCYIVATVDRDLKRRIRKIPGVPIMYISNHRYNIERMPDDYGAPRF

SEQ ID NO: 31463 - protein, 690 aa, Homo sapiens
  Payload ID: 6161
  Gene Symbol: FCHSD1
  Gene Name: FCH and double SH3 domains 1
  Uniprot ID: Q86WN1
  ENSP ID: ENSP00000399259
MQPPPRKVKPAQEVKLRFLEQLSILQTWQQREADLLEDIRSYSKQRAAIEREYGQALQKLAGPFLKREGHRSGEMDSRGRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKALVSELSEHLRDPLTSLSHTELEAAEVILEHAHRGEQTTSQVSWEQDLKLFLQEPGVFSPTPPQQFQPAGTDQVCVLEWGAEGVAGKSGLEKEVQRLTSRAARDYKIQNHGHRVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPDLSLPESSQDSDNPCGAEPTAFLAQALYSYTGQSAEELSFPEGALIRLLPRAQDGVDDGFWRGEFGGRVGVFPSLLVEELLGPPGPPELSDPEQMLPSPSPPSFSPPAPTSVLDGPPAPVLPGDKALDFPGFLDMMAPRLRPMRPPPPPPAKAPDPGHPDPLT

SEQ ID NO: 31464 - protein, 409 aa, Homo sapiens
  Payload ID: 6161
  Gene Symbol: FCHSD1
  Gene Name: FCH and double SH3 domains 1
  Uniprot ID: Q86WN1
  ENSP ID: ENSP00000427796
MDSRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKALVSELSEHLRDPLTSLSHTELEAAEVILEHAHRGEQTTSQVSWEQDLKLFLQEPGVFSPTPPQQFQPAGTDQVCVLEWGAEGVAGKSGLEKEVQRLTSRAARDYKIQNHGHRVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQGVRMS

SEQ ID NO: 31465 - protein, 598 aa, Homo sapiens
  Payload ID: 6161
  Gene Symbol: FCHSD1
  Gene Name: FCH and double SH3 domains 1
  ENSP ID: ENSP00000428677
MQPPPRKVKPAQEVKLRFLEQLSILQTWQQREADLLEDIRSYSKQRAAIEREYGQALQKLAGPFLKREGHRSGEMDSRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKALVSELSEHLRDPLTSLSHTELEAAEVILEHAHRGEQTTSQVSWEQDLKLFLQEPGVFSPTPPQQFQPAGTDQVCVLEWGAEGVAGKSGLEKEVQRLTSRAARDYKIQNHGHRERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPDLSLPESSQDSDNPCGAEPTAFLAQALYSYTGQSAEELSFPEGALIRLLPRAQDGVDDGFWRGEFGGRVGVFPSLLVEELLGPPGPPELSDPEQMLPSPSPPSFSPPAPTSVLDGPPAPVLPGDSGGTCACLSYGYIAYWWRLGF

SEQ ID NO: 31466 - protein, 255 aa, Homo sapiens
  Payload ID: 6161
  Gene Symbol: FCHSD1
  Gene Name: FCH and double SH3 domains 1
  ENSP ID: ENSP00000428776
MQPPPRKVKPAQEVKLRFLEQLSILQTWQQREADLLEDIRSYSKQRAAIEREYGQALQKLAGPFLKREGHRSGEMDSRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKASFNPDTPIPQQGGKGGPPPAS

SEQ ID NO: 31467 - protein, 211 aa, Homo sapiens
  Payload ID: 6161
  Gene Symbol: FCHSD1
  Gene Name: FCH and double SH3 domains 1
  ENSP ID: ENSP00000430448
MYVMQLAKYQSHSKSCPTVFPPTPVLCLPNQVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPD

SEQ ID NO: 31468 - protein, 684 aa, Homo sapiens
  Payload ID: 6162
  Gene Symbol: FCHSD2
  Gene Name: FCH and double SH3 domains 2
  Uniprot ID: O94868
  ENSP ID: ENSP00000308978
MQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 31469 - protein, 515 aa, Homo sapiens
  Payload ID: 6162
  Gene Symbol: FCHSD2
  Gene Name: FCH and double SH3 domains 2
  Uniprot ID: O94868
  ENSP ID: ENSP00000386314
MQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASGKD

SEQ ID NO: 31470 - protein, 740 aa, Homo sapiens
  Payload ID: 6162
  Gene Symbol: FCHSD2
  Gene Name: FCH and double SH3 domains 2
  Uniprot ID: O94868
  ENSP ID: ENSP00000386722
MQPPPRKVKVTQELKNIQVEQMTKLQAKHQAECDLLEDMRTFSQKKAAIEREYAQGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 31471 - protein, 101 aa, Homo sapiens
  Payload ID: 6162
  Gene Symbol: FCHSD2
  Gene Name: FCH and double SH3 domains 2
  ENSP ID: ENSP00000386903
MPVISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 31472 - protein, 764 aa, Homo sapiens
  Payload ID: 6162
  Gene Symbol: FCHSD2
  Gene Name: FCH and double SH3 domains 2
  ENSP ID: ENSP00000386987
MQPPPRKVKVTQELKNIQVEQMTKLQAKHQAECDLLEDMRTFSQKKAAIEREYAQGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSLKAAQLVDIELSPVSALRMTIAESRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 31473 - protein, 604 aa, Homo sapiens
  Payload ID: 6162
  Gene Symbol: FCHSD2
  Gene Name: FCH and double SH3 domains 2
  ENSP ID: ENSP00000402972
MAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSLKAAQLVDIELSPVSALRMTIAESRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 31474 - protein, 117 aa, Homo sapiens
  Payload ID: 6162
  Gene Symbol: FCHSD2
  Gene Name: FCH and double SH3 domains 2
  ENSP ID: ENSP00000406420
  MOD_RES (1)..(1): Any amino acid
XVLNDLECHGAAVSEQSRAELEQKIDEARENIRKAEIIKLKAEARLDLLKQIGVSVDTWLKSAMNQVMEELENERWARPPAVTSNGTLHSIPKEKKAKSLKITWMFSMTAVPALLAP

SEQ ID NO: 31475 - protein, 140 aa, Homo sapiens
  Payload ID: 6162
  Gene Symbol: FCHSD2
  Gene Name: FCH and double SH3 domains 2
  ENSP ID: ENSP00000408706
MTKLQAKHQAECDLLEDMRTFSQKKAAIEREYAQGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQM

SEQ ID NO: 31476 - protein, 85 aa, Homo sapiens
  Payload ID: 6162
  Gene Symbol: FCHSD2
  Gene Name: FCH and double SH3 domains 2
  ENSP ID: ENSP00000441616
  MOD_RES (1)..(1): Any amino acid
XEQMAHAVREKADIEAKSKLSLFQSRISLQKASVKLKARRSECNSKATHARNDYLLTLAAANAHQDRYYQTDLVNIMKVRQTFVI

SEQ ID NO: 31477 - protein, 889 aa, Homo sapiens
  Payload ID: 6163
  Gene Symbol: FCHO1
  Gene Name: FCH domain only 1
  Uniprot ID: O14526
  ENSP ID: ENSP00000252771
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 31478 - protein, 175 aa, Homo sapiens
  Payload ID: 6163
  Gene Symbol: FCHO1
  Gene Name: FCH domain only 1
  ENSP ID: ENSP00000469075
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESL

SEQ ID NO: 31479 - protein, 111 aa, Homo sapiens
  Payload ID: 6163
  Gene Symbol: FCHO1
  Gene Name: FCH domain only 1
  ENSP ID: ENSP00000469425
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHK

SEQ ID NO: 31480 - protein, 28 aa, Homo sapiens
  Payload ID: 6163
  Gene Symbol: FCHO1
  Gene Name: FCH domain only 1
  ENSP ID: ENSP00000469458
MSYFGEHFWGEKNHGFEVLYHSVKQGPI

SEQ ID NO: 31481 - protein, 155 aa, Homo sapiens
  Payload ID: 6163
  Gene Symbol: FCHO1
  Gene Name: FCH domain only 1
  ENSP ID: ENSP00000469511
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRES

SEQ ID NO: 31482 - protein, 42 aa, Homo sapiens
  Payload ID: 6163
  Gene Symbol: FCHO1
  Gene Name: FCH domain only 1
  ENSP ID: ENSP00000469711
MSYFGEHFWGEKNHGFEVLYHSVKQGPISTKELADFIRERAT

SEQ ID NO: 31483 - protein, 23 aa, Homo sapiens
  Payload ID: 6163
  Gene Symbol: FCHO1
  Gene Name: FCH domain only 1
  ENSP ID: ENSP00000469967
MSYFGEHFWGEKNHGFEVLYHSV

SEQ ID NO: 31484 - protein, 35 aa, Homo sapiens
  Payload ID: 6163
  Gene Symbol: FCHO1
  Gene Name: FCH domain only 1
  ENSP ID: ENSP00000470068
MSYFGEHFWGEKNHGFEVLYHSVKQGPISTKELAD

SEQ ID NO: 31485 - protein, 889 aa, Homo sapiens; identical to SEQ ID NO: 31477
  Payload ID: 6163
  Gene Symbol: FCHO1
  Gene Name: FCH domain only 1
  Uniprot ID: O14526
  ENSP ID: ENSP00000470493

SEQ ID NO: 31486 - protein, 134 aa, Homo sapiens
  Payload ID: 6163
  Gene Symbol: FCHO1
  Gene Name: FCH domain only 1
  ENSP ID: ENSP00000470495
MAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNS

SEQ ID NO: 31487 - protein, 92 aa, Homo sapiens
  Payload ID: 6163
  Gene Symbol: FCHO1
  Gene Name: FCH domain only 1
  ENSP ID: ENSP00000470511
MSYFGEHFWGEKNHGFEVLYHSVKQGPISTKELADFIRERATIEETYSKAMAKLSKLASNGTPMGTFAPLWEVFRVSSDKLALCHLELTRKL

SEQ ID NO: 31488 - protein, 896 aa, Homo sapiens
  Payload ID: 6163
  Gene Symbol: FCHO1
  Gene Name: FCH domain only 1
  ENSP ID: ENSP00000470568
MMFSPSFLNLYSHPLQGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 31489 - protein, 235 aa, Homo sapiens
  Payload ID: 6163
  Gene Symbol: FCHO1
  Gene Name: FCH domain only 1
  ENSP ID: ENSP00000470578
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEML

SEQ ID NO: 31490 - protein, 125 aa, Homo sapiens
  Payload ID: 6163
  Gene Symbol: FCHO1
  Gene Name: FCH domain only 1
  ENSP ID: ENSP00000470730
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQ

SEQ ID NO: 31491 - protein, 889 aa, Homo sapiens; identical to SEQ ID NO: 31477
  Payload ID: 6163
  Gene Symbol: FCHO1
  Gene Name: FCH domain only 1
  Uniprot ID: O14526
  ENSP ID: ENSP00000470731

SEQ ID NO: 31492 - protein, 2 aa, Homo sapiens
  Payload ID: 6163
  Gene Symbol: FCHO1
  Gene Name: FCH domain only 1
  ENSP ID: ENSP00000471003
MA

SEQ ID NO: 31493 - protein, 15 aa, Homo sapiens
  Payload ID: 6163
  Gene Symbol: FCHO1
  Gene Name: FCH domain only 1
  ENSP ID: ENSP00000471450
MSYFGEHFWGEKNHG

SEQ ID NO: 31494 - protein, 101 aa, Homo sapiens
  Payload ID: 6163
  Gene Symbol: FCHO1
  Gene Name: FCH domain only 1
  ENSP ID: ENSP00000471563
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLR

SEQ ID NO: 31495 - protein, 264 aa, Homo sapiens
  Payload ID: 6163
  Gene Symbol: FCHO1
  Gene Name: FCH domain only 1
  ENSP ID: ENSP00000471935
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPG

SEQ ID NO: 31496 - protein, 889 aa, Homo sapiens; identical to SEQ ID NO: 31477
  Payload ID: 6163
  Gene Symbol: FCHO1
  Gene Name: FCH domain only 1
  Uniprot ID: O14526
  ENSP ID: ENSP00000472417

SEQ ID NO: 31497 - protein, 97 aa, Homo sapiens
  Payload ID: 6163
  Gene Symbol: FCHO1
  Gene Name: FCH domain only 1
  ENSP ID: ENSP00000472623
MSYFGEHFWGEKNHGFEVLYHSVKQGPISTKELADFIRERATIEETYSKAMAKLSKLASNGTPMGTFAPLWEVFRVSSDKLALCHLELTRKLQDLIK

SEQ ID NO: 31498 - protein, 839 aa, Homo sapiens
  Payload ID: 6163
  Gene Symbol: FCHO1
  Gene Name: FCH domain only 1
  Uniprot ID: O14526
  ENSP ID: ENSP00000472668
MAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 31499 - protein, 891 aa, Homo sapiens
  Payload ID: 6163
  Gene Symbol: FCHO1
  Gene Name: FCH domain only 1
  ENSP ID: ENSP00000473001
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATAAPPQGCTW

SEQ ID NO: 31500 - protein, 218 aa, Homo sapiens
  Payload ID: 6163
  Gene Symbol: FCHO1
  Gene Name: FCH domain only 1
  ENSP ID: ENSP00000473169
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSY

SEQ ID NO: 31501 - protein, 185 aa, Homo sapiens
  Payload ID: 6163
  Gene Symbol: FCHO1
  Gene Name: FCH domain only 1
  ENSP ID: ENSP00000473173
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKVLSGVSQLLPKSRENYLNRCMDQERLRRESTSQKEMDKAETKTKKAAESLRRSVEKYNSARADFEQKMLDSAL

SEQ ID NO: 31502 - protein, 378 aa, Homo sapiens
  Payload ID: 6164
  Gene Symbol: FCHO2
  Gene Name: FCH domain only 2
  ENSP ID: ENSP00000287761
MVMAYFVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAESKGTGKERPGLIEFEECDTASAVEGIKPRKRKTFALPGIIKKEKDAESVWSFTVVAQVGMQWRDLGLLHSPPPRFKRFSSYLSLPSSWNYGAHHHIWLIFCIFSRDRVSPYWPGWSRTPDLR

SEQ ID NO: 31503 - protein, 810 aa, Homo sapiens
  Payload ID: 6164
  Gene Symbol: FCHO2
  Gene Name: FCH domain only 2
  Uniprot ID: Q0JRZ9
  ENSP ID: ENSP00000393776
MVMAYFVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAESKGTGKERPGLIEFEECDTASAVEGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISRHSPVQMNRNLSNEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 31504 - protein, 231 aa, Homo sapiens
  Payload ID: 6164
  Gene Symbol: FCHO2
  Gene Name: FCH domain only 2
  ENSP ID: ENSP00000426842
MVMAYFVENFWGEKNSGFDVLYHNMKHGQISTKELADFVRERTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAE

SEQ ID NO: 31505 - protein, 777 aa, Homo sapiens
  Payload ID: 6164
  Gene Symbol: FCHO2
  Gene Name: FCH domain only 2
  Uniprot ID: Q0JRZ9
  ENSP ID: ENSP00000427296
MVMAYFVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQVHEEFINNMANTTVESLIQKFAESKGTGKERPGLIEFEECDTASAVEGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISRHSPVQMNRNLSNEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 31506 - protein, 555 aa, Homo sapiens
  Payload ID: 6165
  Gene Symbol: FLVCR1
  Gene Name: feline leukemia virus subgroup C cellular receptor 1
  Uniprot ID: Q9Y5Y0
  ENSP ID: ENSP00000355938
MARPDDEEGAAVAPGHPLAKGYLPLPRGAPVGKESVELQNGPKAGTFPVNGAPRDSLAAASGVLGGPQTPLAPEEETQARLLPAGAGAETPGAESSPLPLTALSPRRFVVLLIFSLYSLVNAFQWIQYSIISNVFEGFYGVTLLHIDWLSMVYMLAYVPLIFPATWLLDTRGLRLTALLGSGLNCLGAWIKCGSVQQHLFWVTMLGQCLCSVAQVFILGLPSRIASVWFGPKEVSTACATAVLGNQLGTAVGFLLPPVLVPNTQNDTNLLACNISTMFYGTSAVATLLFILTAIAFKEKPRYPPSQAQAALQDSPPEEYSYKKSIRNLFKNIPFVLLLITYGIMTGAFYSVSTLLNQMILTYYEGEEVNAGRIGLTLVVAGMVGSILCGLWLDYTKTYKQTTLIVYILSFIGMVIFTFTLDLRYIIIVFVTGGVLGFFMTGYLPLGFEFAVEITYPESEGTSSGLLNASAQIFGILFTLAQGKLTSDYGPKAGNIFLCVWMFIGIILTALIKSDLRRHNINIGITNVDVKAIPADSPTDQEPKTVMLSKQSESAI

SEQ ID NO: 31507 - protein, 354 aa, Homo sapiens
  Payload ID: 6165
  Gene Symbol: FLVCR1
  Gene Name: feline leukemia virus subgroup C cellular receptor 1
  ENSP ID: ENSP00000414680
  MOD_RES (1)..(1): Any amino acid
XAYVPLIFPATWLLDTRGLRLTALLGSGLNCLGAWIKCGSVQQHLFWVTMLGQCLCSVAQVFILGLPSRIASVWFGPKEVSTACATAVLGNQLGTAVGFLLPPVLVPNTQNDTNLLACNISTMFYGTSAVATLLFILTAIGIMTGAFYSVSTLLNQMILTYYEGEEVNAGRIGLTLVVAGMVGSILCGLWLDYTKTYKQTTLIVYILSFIGMVIFTFTLDLRYIIIVFVTGGVLGFFMTGYLPLGFEFAVEITYPESEGTSSGLLNASAQIFGILFTLAQGKLTSDYGPKAGNIFLCVWMFIGIILTALIKSDLRRHNINIGITNVDVKAIPADSPTDQEPKTVMLSKQSESAI

SEQ ID NO: 31508 - protein, 526 aa, Homo sapiens
  Payload ID: 6166
  Gene Symbol: FLVCR2
  Gene Name: feline leukemia virus subgroup C cellular receptor family, member 2
  Uniprot ID: Q9UPI3
  ENSP ID: ENSP00000238667
MVNEGPNQEESDDTPVPESALQADPSVSVHPSVSVHPSVSINPSVSVHPSSSAHPSALAQPSGLAHPSSSGPEDLSVIKVSRRRWAVVLVFSCYSMCNSFQWIQYGSINNIFMHFYGVSAFAIDWLSMCYMLTYIPLLLPVAWLLEKFGLRTIALTGSALNCLGAWVKLGSLKPHLFPVTVVGQLICSVAQVFILGMPSRIASVWFGANEVSTACSVAVFGNQLGIAIGFLVPPVLVPNIEDRDELAYHISIMFYIIGGVATLLLILVIIVFKEKPKYPPSRAQSLSYALTSPDASYLGSIARLFKNLNFVLLVITYGLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLENKLQEEEEESNTSKVPTAVSEDHL

SEQ ID NO: 31509 - protein, 321 aa, Homo sapiens
  Payload ID: 6166
  Gene Symbol: FLVCR2
  Gene Name: feline leukemia virus subgroup C cellular receptor family, member 2
  Uniprot ID: Q9UPI3
  ENSP ID: ENSP00000443439
MSADNSSTICVCRSVRQELGIAIGFLVPPVLVPNIEDRDELAYHISIMFYIIGGVATLLLILVIIVFKEKPKYPPSRAQSLSYALTSPDASYLGSIARLFKNLNFVLLVITYGLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLENKLQEEEEESNTSKVPTAVSEDHL

SEQ ID NO: 31510 - protein, 88 aa, Homo sapiens
  Payload ID: 6166
  Gene Symbol: FLVCR2
  Gene Name: feline leukemia virus subgroup C cellular receptor family, member 2
  ENSP ID: ENSP00000451104
MFYIIGGVATLLLILVIIVFKEKPKYPPSRAQSLSYALTSPDASYLGSIARLFKNLNFVLLVITYGLNAGAFYALSTLLNRMVIWHYP

SEQ ID NO: 31511 - protein, 133 aa, Homo sapiens
  Payload ID: 6166
  Gene Symbol: FLVCR2
  Gene Name: feline leukemia virus subgroup C cellular receptor family, member 2
  ENSP ID: ENSP00000451603
MFYIIGGVATLLLILVIIVFKEKPKYPPSRAQSLSYALTSPDASYLGSIARLFKNLNFVLLVITYGLNAGAFYALSTLLNRMVIWHYPGEEVNAGRIGLTIVIAGMLGAVISGIWLDRSKTYKNLCHPNCLIQ

SEQ ID NO: 31512 - protein, 203 aa, Homo sapiens
  Payload ID: 6166
  Gene Symbol: FLVCR2
  Gene Name: feline leukemia virus subgroup C cellular receptor family, member 2
  ENSP ID: ENSP00000451781
MSPYGISSLGNGLSKWLSLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLEN

SEQ ID NO: 31513 - protein, 241 aa, Homo sapiens
  Payload ID: 6166
  Gene Symbol: FLVCR2
  Gene Name: feline leukemia virus subgroup C cellular receptor family, member 2
  ENSP ID: ENSP00000452453
MCPDLHPSKYVQPPLSSSSSPLKGGQEAFSPLGLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLENKLQEEEEESNTSKVPTAVSEDHL

SEQ ID NO: 31514 - protein, 93 aa, Homo sapiens
  Payload ID: 6166
  Gene Symbol: FLVCR2
  Gene Name: feline leukemia virus subgroup C cellular receptor family, member 2
  ENSP ID: ENSP00000452468
MFYIIGGVATLLLILVIIVFKEKPKYPPSRAQSLSYALTSPDASYLGSIARLFKNLNFVLLVITYETPRGGGGEQHQQSAHCCVRGSSLRGRW

SEQ ID NO: 31515 - protein, 203 aa, Homo sapiens
  Payload ID: 6166
  Gene Symbol: FLVCR2
  Gene Name: feline leukemia virus subgroup C cellular receptor family, member 2
  ENSP ID: ENSP00000452584
MFYIIGGVATLLLILVIIGLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLE

SEQ ID NO: 31516 - protein, 669 aa, Homo sapiens
  Payload ID: 6167
  Gene Symbol: FEM1A
  Gene Name: fem-1 homolog a (C. elegans)
  Uniprot ID: Q9BSK4
  ENSP ID: ENSP00000269856
MDLRTAVYNAARDGKLQLLQKLLSGRSREELDELTGEVAGGGTPLLIAARYGHLDVVEYLVDRCGASVEAGGSVHFDGETIEGAPPLWAASAAGHLDVVRSLLRRGASVNRTTRTNSTPLRAACFDGHLEVVRYLVGEHQADLEVANRHGHTCLMISCYKGHREIARYLLEQGAQVNRRSAKGNTALHDCAESGSLEILQLLLGCKARMERDGYGMTPLLAASVTGHTNIVEYLIQEQPGQEQVAGGEAQPGLPQEDPSTSQGCAQPQGAPCCSSSPEEPLNGESYESCCPTSREAAVEALELLGATYVDKKRDLLGALKHWRRAMELRHQGGEYLPKPEPPQLVLAYDYSREVNTTEELEALITDPDEMRMQALLIRERILGPSHPDTSYYIRYRGAVYADSGNFERCIRLWKYALDMQQSNLEPLSPMTASSFLSFAELFSYVLQDRAAKGSLGTQIGFADLMGVLTKGVREVERALQLPREPGDSAQFTKALAIILHLLYLLEKVECTPSQEHLKHQTVYRLLKCAPRGKNGFTPLHMAVDKDTTNVGRYPVGRFPSLHVVKVLLDCGADPDSRDFDNNTPLHIAAQNNCPAIMNALIEAGAHMDATNAFKKTAYELLDEKLLARGTMQPFNYVTLQCLAARALDKNKIPYKGFIPEDLEAFIELH

SEQ ID NO: 31517 - protein, 627 aa, Homo sapiens
  Payload ID: 6168
  Gene Symbol: FEM1B
  Gene Name: fem-1 homolog b (C. elegans)
  Uniprot ID: Q9UK73
  ENSP ID: ENSP00000307298
MEGLAGYVYKAASEGKVLTLAALLLNRSESDIRYLLGYVSQQGGQRSTPLIIAARNGHAKVVRLLLEHYRVQTQQTGTVRFDGYVIDGATALWCAAGAGHFEVVKLLVSHGANVNHTTVTNSTPLRAACFDGRLDIVKYLVENNANISIANKYDNTCLMIAAYKGHTDVVRYLLEQRADPNAKAHCGATALHFAAEAGHIDIVKELIKWRAAIVVNGHGMTPLKVAAESCKADVVELLLSHADCDRRSRIEALELLGASFANDRENYDIIKTYHYLYLAMLERFQDGDNILEKEVLPPIHAYGNRTECRNPQELESIRQDRDALHMEGLIVRERILGADNIDVSHPIIYRGAVYADNMEFEQCIKLWLHALHLRQKGNRNTHKDLLRFAQVFSQMIHLNETVKAPDIECVLRCSVLEIEQSMNRVKNISDADVHNAMDNYECNLYTFLYLVCISTKTQCSEEDQCKINKQIYNLIHLDPRTREGFTLLHLAVNSNTPVDDFHTNDVCSFPNALVTKLLLDCGAEVNAVDNEGNSALHIIVQYNRPISDFLTLHSIIISLVEAGAHTDMTNKQNKTPLDKSTTGVSEILLKTQMKMSLKCLAARAVRANDINYQDQIPRTLEEFVGFH

SEQ ID NO: 31518 - protein, 269 aa, Homo sapiens
  Payload ID: 6168
  Gene Symbol: FEM1B
  Gene Name: fem-1 homolog b (C. elegans)
  ENSP ID: ENSP00000456968
  MOD_RES (1)..(1): Any amino acid
XDGDNILEKEVLPPIHAYGNRTECRNPQELESIRQDRDALHMEGLIVRERILGADNIDVSHPIIYRGAVYADNMEFEQCIKLWLHALHLRQKVCISTKTQCSEEDQCKINKQIYNLIHLDPRTREGFTLLHLAVNSNTPVDDFHTNDVCSFPNALVTKLLLDCGAEVNAVDNEGNSALHIIVQYNRPISDFLTLHSIIISLVEAGAHTDMTNKQNKTPLDKSTTGVSEILLKTQMKMSLKCLAARAVRANDINYQDQIPRTLEEFVGFH

SEQ ID NO: 31519 - protein, 4 aa, Homo sapiens
  Payload ID: 6168
  Gene Symbol: FEM1B
  Gene Name: fem-1 homolog b (C. elegans)
  ENSP ID: ENSP00000457002
MIAA

SEQ ID NO: 31520 - protein, 80 aa, Homo sapiens
  Payload ID: 6168
  Gene Symbol: FEM1B
  Gene Name: fem-1 homolog b (C. elegans)
  ENSP ID: ENSP00000457342
MIAAYKGHTDVVRYLLEQRADPNAKAHCGATALHFAAEAGHIDIVKELIKWRAAIVVNGHGMTPLKVAAESCKADVVELL

SEQ ID NO: 31521 - protein, 617 aa, Homo sapiens
  Payload ID: 6169
  Gene Symbol: FEM1C
  Gene Name: fem-1 homolog c (C. elegans)
  Uniprot ID: Q96JP0
  ENSP ID: ENSP00000274457
MDLKTAVFNAARDGKLRLLTKLLASKSKEEVSSLISEKTNGATPLLMAARYGHLDMVEFLLEQCSASIEVGGSVNFDGETIEGAPPLWAASAAGHLKVVQSLLNHGASVNNTTLTNSTPLRAACFDGHLEIVKYLVEHKADLEVSNRHGHTCLMISCYKGHKEIAQYLLEKGADVNRKSVKGNTALHDCAESGSLDIMKMLLMYCAKMEKDGYGMTPLLSASVTGHTNIVDFLTHHAQTSKTERINALELLGATFVDKKRDLLGALKYWKKAMNMRYSDRTNIISKPVPQTLIMAYDYAKEVNSAEELEGLIADPDEMRMQALLIRERILGPSHPDTSYYIRYRGAVYADSGNFKRCINLWKYALDMQQSNLDPLSPMTASSLLSFAELFSFMLQDRAKGLLGTTVTFDDLMGILCKSVLEIERAIKQTQCPADPLQLNKALSIILHLICLLEKVPCTLEQDHFKKQTIYRFLKLHPRGKNNFSPLHLAVDKNTTCVGRYPVCKFPSLQVTAILIECGADVNVRDSDDNSPLHIAALNNHPDIMNLLIKSGAHFDATNLHKQTASDLLDEKEIAKNLIQPINHTTLQCLAARVIVNHRIYYKGHIPEKLETFVSLHR

SEQ ID NO: 31522 - protein, 822 aa, Homo sapiens
  Payload ID: 6170
  Gene Symbol: FER
  Gene Name: fer (fps/fes related) tyrosine kinase
  Uniprot ID: P16591
  ENSP ID: ENSP00000281092
MGFGSDLKNSHEAVLKLQDWELRLLETVKKFMALRIKSDKEYASTLQNLCNQVDKESTVQMNYVSNVSKSWLLMIQQTEQLSRIMKTHAEDLNSGPLHRLTMMIKDKQQVKKSYIGVHQQIEAEMIKVTKTELEKLKCSYRQLIKEMNSAKEKYKEALAKGKETEKAKERYDKATMKLHMLHNQYVLALKGAQLHQNQYYDITLPLLLDSLQKMQEEMIKALKGIFDEYSQITSLVTEEIVNVHKEIQMSVEQIDPSTEYNNFIDVHRTTAAKEQEIEFDTSLLEENENLQANEIMWNNLTAESLQVMLKTLAEELMQTQQMLLNKEEAVLELEKRIEESSETCEKKSDIVLLLSQKQALEELKQSVQQLRCTEAKFSAQKELLEQKVQENDGKEPPPVVNYEEDARSVTSMERKERLSKFESIRHSIAGIIRSPKSALGSSALSDMISISEKPLAEQDWYHGAIPRIEAQELLKKQGDFLVRESHGKPGEYVLSVYSDGQRRHFIIQYVDNMYRFEGTGFSNIPQLIDHHYTTKQVITKKSGVVLLNPIPKDKKWILSHEDVILGELLGKGNFGEVYKGTLKDKTSVAVKTCKEDLPQELKIKFLQEAKILKQYDHPNIVKLIGVCTQRQPVYIIMELVSGGDFLTFLRRKKDELKLKQLVKFSLDAAAGMLYLESKNCIHRDLAARNCLVGENNVLKISDFGMSRQEDGGVYSSSGLKQIPIKWTAPEALNYGRYSSESDVWSFGILLWETFSLGVCPYPGMTNQQAREQVERGYRMSAPQHCPEDISKIMMKCWDYKPENRPKFSELQKELTIIKRKLT

SEQ ID NO: 31523 - protein, 411 aa, Homo sapiens
  Payload ID: 6170
  Gene Symbol: FER
  Gene Name: fer (fps/fes related) tyrosine kinase
  ENSP ID: ENSP00000394297
MERKERLSKFESIRHSIAGIIRSPKSALGSSALSDMISISEKPLAEQDWYHGAIPRIEAQELLKKQGDFLVRESHGKPGEYVLSVYSDGQRRHFIIQYVDNMYRFEGTGFSNIPQLIDHHYTTKQVITKKSGVVLLNPIPKDKKWILSHEDVILGELLGKGNFGEVYKGTLKDKTSVAVKTCKEDLPQELKIKFLQEAKILKQYDHPNIVKLIGVCTQRQPVYIIMELVSGGDFLTFLRRKKDELKLKQLVKFSLDAAAGMLYLESKNCIHRDLAARNCLVGENNVLKISDFGMSRQEDGGVYSSSGLKQIPIKWTAPEALNYGRYSSESDVWSFGILLWETFSLGVCPYPGMTNQQAREQVERGYRMSAPQHCPEDISKIMMKCWDYKPENRPKFSELQKELTIIKRKLT

SEQ ID NO: 31524 - protein, 84 aa, Homo sapiens
  Payload ID: 6170
  Gene Symbol: FER
  Gene Name: fer (fps/fes related) tyrosine kinase
  ENSP ID: ENSP00000421951
MGFGSDLKNSHEAVLKLQDWELRLLETVKKFMALRIKSDKEYASTLQNLCNQVDKESTVQMNYVSNVSKGRKLKRPRNDTTKPQ

SEQ ID NO: 31525 - protein, 453 aa, Homo sapiens
  Payload ID: 6170
  Gene Symbol: FER
  Gene Name: fer (fps/fes related) tyrosine kinase
  Uniprot ID: P16591
  ENSP ID: ENSP00000484767
MEQKMKCPHCKDQLESGFGSQSCKTCALMFSSEPSTSEVHRDQERKERLSKFESIRHSIAGIIRSPKSALGSSALSDMISISEKPLAEQDWYHGAIPRIEAQELLKKQGDFLVRESHGKPGEYVLSVYSDGQRRHFIIQYVDNMYRFEGTGFSNIPQLIDHHYTTKQVITKKSGVVLLNPIPKDKKWILSHEDVILGELLGKGNFGEVYKGTLKDKTSVAVKTCKEDLPQELKIKFLQEAKILKQYDHPNIVKLIGVCTQRQPVYIIMELVSGGDFLTFLRRKKDELKLKQLVKFSLDAAAGMLYLESKNCIHRDLAARNCLVGENNVLKISDFGMSRQEDGGVYSSSGLKQIPIKWTAPEALNYGRYSSESDVWSFGILLWETFSLGVCPYPGMTNQQAREQVERGYRMSAPQHCPEDISKIMMKCWDYKPENRPKFSELQKELTIIKRKLT

SEQ ID NO: 31526 - protein, 163 aa, Homo sapiens [sequence omitted]

SEQ ID NO: 31527 - protein, 2093 aa, Homo sapiens
  Payload ID: 6171
  Gene Symbol: FER1L5
  Gene Name: fer-1-like family member 5
  Uniprot ID: A0AVI2
  ENSP ID: ENSP00000485044
MLRLVVQSAKIDPPLAPLPRPCMSIDFRDIKKRTRVVEGNDPVWNETLIWHLWNRPLENDSFLQVTLQDMGSQKKERFIGLATVLLKPLLKQPSEVLFVKDLTLLNHSMKPTDCTVTLQVAHMSNQDIEKTGAEDHLGITAREAASQKLMVPGSTAHRALSSKPQHFQVRVKVFEARQLMGNNIKPVVKVSIAGQQHQTRIKMGNNPFFNEIFFQNFHEVPAKFFDETILIQTDIGFIYHSPGHTLLRKWLGLCQPNNPGSGVTGYLKVTIYALGVGDQALIDQKLLYGTDDTDIQIFKSAVVPINMAYLQLFIYCAEDLHLKKHQSVNPQLEVELIGEKLRTHMQTQTDNPIWNQILTFRIQLPCLSSYIKFRVLDCRKKDCPDEIGTASLSLNQISSTGEEIEGKQSLEPTSYTPRVYSGFLPCFGPSFLTLHGGKKAPFRIQEEGACIPDSVRDGLAYRGRVFLELITQIKSYQDSTIKDLSHEVTRIEKHQNRQKYGLCVIFLSCTMMPNFKELIHFEVSIGHYGNKMDLNYKPLVSSTPYSPVIYDGNIYHYVPWYNTKPVVAVTSNWEDVSFRMNCLNLLHFTRDRLKANLDTLKSTRNPKDPALLYQWEKLLRELAEDCKRPLPCMTYQPKATSLDRKRWQLRSLLLQELAQKAKQAKPKDMVATAEDWLYRLNTVLPEPQMGLPDVMIWLVAKEQRVAYAQVPAHSVLFSPAGALHSGRLCGKIQTLFLQYPEGEGQKDVLPAHLRVCMWLGNVTDSKDLQLLRQGDTAVYAEMYENQAKYKDQWGQQGLYHCPNFSDVMGNKTLPMTDFQPPLGWHWQDSWTVEPQRRLLLDIDINKSQVLEEVYENQGRDTRGAWGPAAIPNTDVNGQPMEARENVKCPQGWHFKKDWVVELNHAVDSWEYGVGIPPSGLPQVWSPVEKTYHSCRRRRWARVRFRNHGELSHEQETLSFLQLGLAKGEEEGWEYDTFGSKFHLNPQPQSRFRRRCWRRRLAPNKDKGIAPIFLLEGSLACEGGSVREEGDWAWARGNRSSTQEPQGRLSWVQAMDLKYHAGKEEDSKTWPWGLDRQFRDPQRQDTRPPNLPFIYCTFNKPHYYQLFCYIYQARNLVSNQILTFQGPFIRVVFLNHSQCTQTLRSSAGPTWAQTLIFQHLLLYENPQDTKESPPLVVLELWQRDFWGKESLWGRSVWPPMVWLDLQDRILPPMRWHPLVKELGKEEGEILASCELILQTEKLGEKQLPILSVPWKNGAYTLPKSIQPTIKRMAIEILAWGLRNMKKASSPQLLVEFGEESLRTEPIRDFQTNPNFPESESVLVLTVLMPTEEAYALPLVVKVVDNWAFGQQTVTGQANIDFLQPYFCDPWAQDYMHPKLPTLSEKKHQDFLGYLYRKFWFKSSKAEDEYEHEVDWWSKLFWATDEHKSLKYKYKDYHTLKVYECELEAVPAFQGLQDFCQTFKLYQEQPKLDSPVVGEFKGLFRIYPFPENPEAPKPPLQFLVWPEREDFPQPCLVRVYMVRAINLQPQDYNGLCDPYVILKLGKTELGNRDMYQPNTLDPIFGMMFELTCNIPLEKDLEIQLYDFDLFSPDDKIGTTVIDLENRLLSGFGAHCGLSKSYCQSGPFRWRDQMPPSYLLERYAKRKGLPPPLFSPEEDAVFYNGKKFKLQSFEPKTPTVHGLGPKKERLALYLLHTQGLVPEHVETRTLYSHSQPGIDQGKVQMWVDIFPKKLGPPGPQVNINPRKPKRKASEHSGHRYELRCIIWKTANVDLVDDNLSREKTSDIYIKGWLYGLEKDMQKTDIHYHSLTGEADFNWRFIFTMDYLAAERTCVQSQKDYIWSLDATSMKFPARLIIQVWDNDIFSPDDFLGVLELDLSDMPLPARHAKQCSIRMMDADPKWPYFIQYKHFSLFKKKTVTGWWPCQVLDGGKWRLSGKVKMSLEILSEKEALIKPAGRGQSEPNQYPTLHPPLRTNTSFTWLRSPVQNFCYIFWKRYRFKLIAFMVISIIALMLFNFIYSAPHYLAMSWIKPQLQLYPPIKIFNIINSLNTSNASSSILPTQDPNLKPTIDHEWKLHPGPTNHLSDIFPELPAPGD

SEQ ID NO: 31528 - protein, 2057 aa, Homo sapiens
  Payload ID: 6171
  Gene Symbol: FER1L5
  Gene Name: fer-1-like family member 5
  ENSP ID: ENSP00000485238
MLRLVVQSAKIDPPLAPLPRPCMSIDFRDIKKRTRVVEGNDPVWNETLIWHLWNRPLENDSFLQVTLQDMGSQKKERFIGLATVLLKPLLKQPSEVLFVKDLTLLNHSMKPTDCTVTLQVAHMSNQDIEKTGAEDHLGITAREAASQKLMVPGSTAHRALSSKPQHFQVRVKVFEARQLMGNNIKPVVKVSIAGQQHQTRIKMGNNPFFNEIFFQNFHEVPAKFFDETILIQVVNSSAMRYKAEIGRFQTDIGFIYHSPGHTLLRKWLGLCQPNNPGSGVTGYLKVTIYALGVGDQALIDQKLLYGTDDTDIQIFKSAVVPINMAYLQLFIYCAEDLHLKKHQSVNPQLEVELIGEKLRTHMQTQTDNPIWNQILTFRIQLPCLSSYIKFRVLDCRKKDCPDEIGTASLSLNQISSTGEEIEGVYSGFLPCFGPSFLTLHGGKKAPFRIQEEGACIPDSVRDGLAYRGRVFLELITQIKSYQDSTIKDLSHEVTRIEKHQNRQKYGLCVIFLSCTMMPNFKELIHFEVSIGHYGNKMDLNYKPLVSSTPYSPVIYDGNIYHYVPWYNTKPVVAVTSNWEDVSFRMNCLNLLHFTRDRLKANLDTLKSTRNPKDPALLYQWEKLLRELAEDCKRPLPCMTYQPKATSLDRKRWQLRSLLLQELAQKAKQAKPKDMVATAEDWLYRLNTVLPEPQMGLPDVMIWLVAKEQRVAYAQVPAHSVLFSPAGALHSGRLCGKIQTLFLQYPEGEGQKDVLPAHLRVCMWLGNVTDSKDLQLLRQGDTAVYAEMYENQAKYKDQWGQQGLYHCPNFSDVMGNKTLPMTDFQPPLGWHWQDSWTVEPQRRLLLDIDINKSQVLEEVYENQGRDTRGAWGPAAIPNTDVNGQPMEARENVKCPQGWHFKKDWVVELNHAVDSKGWEYGVGIPPSGLPQVWSPVEKTYHSCRRRRWARVRFRNHGELSHEQETLSFLQLGLAKGEEEGWEYDTFGSKFHLNPQPQSRFRRRCWRRRLAPNKDKGIAPIFLLEGSLAMDLKYHAGKEEDSKTWPWGLDRQFRDPQRQDTRPPNLPFIYCTFNKPHYYQLFCYIYQARNLVSNQILTFQGPFIRVVFLNHSQCTQTLRSSAGPTWAQTLIFQHLLLYENPQDTKESPPLVVLELWQRDFWGKESLWGRSVWPPMVWLDLQDRILPPMRWHPLVKELGKEEGEILASCELILQTEKLGEKQLPILSVPWKNGAYTLPKSIQPTIKRMAIEILAWGLRNMKKASSPQLLVEFGEESLRTEPIRDFQTNPNFPESESVLVLTVLMPTEEAYALPLVVKVVDNWAFGQQTVTGQANIDFLQPYFCDPWAQDYMHPKLPTLSEKKHQDFLGYLYRKFWFKSSKAEDEYEHEVDWWSKLFWATDEHKSLKYKYKDYHTLKVYECELEAVPAFQGLQDFCQTFKLYQEQPKLDSPVVGEFKGLFRIYPFPENPEAPKPPLQFLVWPEREDFPQPCLVRVYMVRAINLQPQDYNGLCDPYVILKLGKTELGNRDMYQPNTLDPIFGMMFELTCNIPLEKDLEIQLYDFDLFSPDDKIGTTVIDLENRLLSGFGAHCGLSKSYCQSGPFRWRDQMPPSYLLERYAKRKGLPPPLFSPEEDAVFYNGKKFKLQSFEPKTPTVHGLGPKKERLALYLLHTQGLVPEHVETRTLYSHSQPGIDQGKVQMWVDIFPKKLGPPGPQVNINPRKPKRYELRCIIWKTANVDLVDDNLSREKTSDIYIKGWLYGLEKDMQKTDIHYHSLTGEADFNWRFIFTMDYLAAERTCVQSQKDYIWSLDATSMKFPARLIIQVWDNDIFSPDDFLGVLELDLSDMPLPARHAKQCSIRMMDADPKWPYFIQYKHFSLFKKKTVTGWWPCQVLDGGKWRLSGKVKMSLEILSEKEALIKPAGRGQSEPNQYPTLHPPLRTNTSFTWLRSPVQNFCYIFWKRYRFKLIAFMVISIIALMLFNFIYSAPHYLAMSWIKPQLQLYPPIKIFNIINSLNTSNASSSILPTQDPNLKPTIDHEWKLHPGPTNHLSDIFPELPAPGD

SEQ ID NO: 31529 - protein, 2097 aa, Homo sapiens [sequence omitted]

SEQ ID NO: 31530 - protein, 1761 aa, Homo sapiens [sequence omitted]

SEQ ID NO: 31531 - protein, 1857 aa, Homo sapiens
  Payload ID: 6172
  Gene Symbol: FER1L6
  Gene Name: fer-1-like family member 6
  Uniprot ID: Q2WGJ9
  ENSP ID: ENSP00000381982
MFGLKVKKKRNKAEKGLILANKAAKDSQGDTEALQEEPSHQEGPRGDLVHDDASIFPVPSASPKRRSKLLTKIHDGEVRSQNYQIAITITEARQLVGENIDPVVTIEIGDEKKQSTVKEGTNSPFYNEYFVFDFIGPQVHLFDKIIKISVFHHKLIGSVLIGSFKVDLGTVYNQPGHQFCNKWALLTDPGDIRTGTKGYLKCDISVMGKGDVLKTSPKTSDTEEPIEKNLLIPNGFPLERPWARFYVRLYKAEGLPKMNSSIMANVTKAFVGDSKDLVDPFVEVSFAGQMGRTTVQKNCADPVWHEQVIFKEMFPPLCRRVKIQVWDEGSMNDVALATHFIDLKKISNEQDGDKGFLPTFGPAWINLYGSPRNHSLMDDYQEMNEGFGEGVSFRGRILVEIAVEILSGRAQESKFSKALKELKLPSKDKDSKSSKGKDKADKTEDGKSQQASNKTNSTEVEVESFDVPPEIVPEKNEEFLLFGAFFEATMIDRKIGDKPISFEVSIGNFGNLIDGGSHHGSKKSAESAEEDLLPLLHEGQGDVAHDVPIPMASTTHPEKPLVTEGNRNYNYLPFEAKKPCVYFISSWGDQTFRLHWSNMLEKMADFLEESIEEVRELIKISQEAPEEKMKTVLSDFISRSSAFISEAEKKPKMLNQTTLDKKRLTLCWQELEAMCKEAKGIIQQQKKKLSVDEMIHEAQNFVEKIRFLVDEPQHTIPDVFIWMLSNNRRVAYARIASKDLLYSPVAGQMGKHCGKIKTHFLKPPGKRPAGWSVQAKVDVYLWLGSIKHASAILDNLPVGYEAEMSSKGAGTNHPPSNLLYQEQHVFQLRAHMYQARGLIAADSNGLSDPFAKVTFLSHCQTTKIISQTLSPTWNQMLLFNDLVLHGDVKELAESPPLVVVELYDSDAVGKPEYLGATVAAPVVKLADQDYEPPRLCYHPIFCGNLSGGDLLAVFELLQVPPSGLQGLPPVEPPDITQIYPVPANIRPVLSKYRVEVLFWGVREMKKVQLLSVDRPQALIECGGQGVKSCVIQSYKNNPNFSIQADAFEVELPENELLHPPLSICVVDWRAFGRSTLVGTYTINYLKQFLCKLREPLAPITQVDGTQPGHDISDSLTATESSGAHSSSQDPPADHIYVDVEPPPTVVPDSAQAQPAILVDVPDSSPMLEPEHTPVAQEPPKDGKPKDPRKPSRRSTKRRKRTIADESAENVIDWWSKYYASLKKAQKAKERNPKGKKGNTEAKPDEVVVDIEDGPKKKKDKMLKKKPKDDGIPNLAILQIYDGDLESEFNNFEDWVKTFELFRGKSTEDDHGLDGDRVIGKFKGSFCIYKSPQDSSSEDSGQLRIQQGIPPNHPVTVLIRVYIVAAFNLSPADPDGKSDPYIVIKLGKTEIKDRDKYIPKQLNPVFGRSFEIQATFPKESLLSILIYDHDMIGTDDLIGETKIDLENRFYSKHRAICGLQSQYEIEGYNAWRDTSKPTEILTKLCKDNKLDGPYFHPGKIQIGNQVFSGKTIFTEEDTDETVESYEHLALKVLHSWEDIPEVGCRLVPEHIETRPLYHKDKPGMEQGRLQMWVDMFPKDMPQPGPPVDISPRRPKGYELRVTIWNTEDVILEDENIFTGQKSSDIYVKGWLKGLEDDKQETDVHYNSLTGEGNFNWRFLFPFQYLPAEKQMVITKRENIFSLEKMECKTPAVLVLQVWDFERLSSDDFLGTLEMNLNSFPRAAKSAKACDLAKFENASEETKISIFQQKRVRGWWPFSKSKELTGKVEAEFHLVTAEEAEKNPVGKARKEPEPLAKPNRPDTSFSWFMSPFKCLYYLIWKNYKKYIIIAFILIILIIFLVLFIYTLPGAISRRIVVGS

SEQ ID NO: 31532 - protein, 1857 aa, Homo sapiens; identical to SEQ ID NO: 31531
  Payload ID: 6172
  Gene Symbol: FER1L6
  Gene Name: fer-1-like family member 6
  Uniprot ID: Q2WGJ9
  ENSP ID: ENSP00000428280

SEQ ID NO: 31533 - protein, 166 aa, Homo sapiens
  Payload ID: 6173
  Gene Symbol: FERD3L
  Gene Name: Fer3-like bHLH transcription factor
  Uniprot ID: Q96RJ6
  ENSP ID: ENSP00000275461
MAAYPESCVDTTVLDFVADLSLASPRRPLLCDFAPGVSLGDPALALREGRPRRMARFEEGDPEEEECEVDQGDGEEEEEEERGRGVSLLGRPKRKRVITYAQRQAANIRERKRMFNLNEAFDQLRRKVPTFAYEKRLSRIETLRLAIVYISFMTELLESCEKKESG

SEQ ID NO: 31534 - protein, 1578 aa, Homo sapiens
  Payload ID: 6174
  Gene Symbol: FRMPD1
  Gene Name: FERM and PDZ domain containing 1
  Uniprot ID: Q5SYB0
  ENSP ID: ENSP00000366995
MEELETSLFQTRKAHRIEQMVARWLRRSRDSSARAKVAAADGPARNPTQTLIPVRHTVKIDKDTLLQDYGFHISESLPLTVVAVTAGGSAHGKLFPGDQILQMNNEPAEDLSWERAVDILREAEDSLSITVVRCTSGVPKSSFLTEEKRARLKTNPVKVHFAEEVLISGHSQGNSLLCMPNVLKLYLENGQTKAFKFEANTTVKDIILTVKEKLSIRSIEYFALALEEQYSISRLHLLHEEELIQQVVEREESHDYRCLFRVCFVPKDPLDLLKEDPVAFEYLYLQSCSDVLQERFAVEMKCSSALRLAALHIQERIYACAQPQKISLKYIEKDWGIENFISPTLLRNMKGKDIKKAISFHMKRNQNLLEPRQKQLISAAQLRLNYLQILGELKTYGGRIFNATLMLQDRESYIALLVGAKYGISQVINSKLNIMSTLAEFANISRVELTEESEKVSVVKVYLQDVKVLTLLLESNSAKDLACLIAGYYRLLVDPVTSIFLWPGNKQQAHRVSAEEGYESRACSDSEESSEVDCVLEPLSDRRLVKLAPCRSLIKEEQPPGNSPTPEVARRGPSTCGASSTTDSAESEASDSANTESRGYRTSGSSESMDALEEDDLDTCSSSRSTFFHFGSPGLAESIDSDSQEERSGIETSGFLCLLDLAQRANPQCQKTEFSESAALETFGWAPELSTVRLDPRLYEGSHADYYSLCSSVSPASYLSDSSESTASRQGGAPPAWGQQGWTEAQPSSMLEPLALHPPLAFEDGSSDEEYYDAADKLTPPGPPSGPRDVSTAEPSATSLQNKASTSSPENSLPCGPDGRQPSRRGGVKKYAKTLRKRRSFLQTDYTSQVSFPLVPSASLESVDDVCYYDREPYLALGAPSPTVSSLQDMQGEPGLLETKALGLLAPLRETKSTNPASRVMEMEPETMETKSVIDSRVSSISAIRFRIDPNNKENSGVVPAASSSASTPHCSNPGSSGPDTAQARPSQILPLSQDLDGIAPKEPTIEHGDSSFSLSSGDPNPDRACLASNPGLNNVSQGDTLELQLEPHVQLEMGLESFCTNHIQETAPKYTEPLLSPRDEPRSDECGINPGEKIASIPTKEEPQGQLSLERDREVTNKNGTNVFQEESRKDSGDSPGDVSNNVSQTLDISSPAGKIVTSLSLDAPVTGTEQIPPHPPRDPQGQSREPPGQGCQAQEQKLFVELDLDPDFFLGKQTVSPAVPPEGIKAEAPNHVTGQDIAPRDSPEWVCFNPEPSLPEPLPCPQEDPHLETSNHCLLSEGKSDSSSICLSAEKSFLCFAPESHPEVSASLRVATSLGFAGMNEMVAPRIGMDQCSCQFSYATCFRGPQPETEEEDRDLEAHPMAPLTSPPSAGSPVVLPWRPARAHSCTTAPLSRKSHIWPEYCSRALRQLKATPASTPEGFIQLMESLLELQDILETSWGVGNKHPPEKCTWHFTESRSRLCMGSQKLLSSCRHVIRMDQSPEEMQGAVRDTFQHLVQLAGLCFQFTDCSRCSARHREAAGNLRDVVYTYHQFIEAAKSTCERGYHDLSVKLLARQCTALTAAVFCLTQKFRASTAL

SEQ ID NO: 31535 - protein, 62 aa, Homo sapiens
  Payload ID: 6174
  Gene Symbol: FRMPD1
  Gene Name: FERM and PDZ domain containing 1
  ENSP ID: ENSP00000439868
MEELETSLFQTRKAHRIEQMVARWLRRSRDSSARAKVAAADGPARNPTQTLIPVRHTVKIDK

SEQ ID NO: 31536 - protein, 1578 aa, Homo sapiens; identical to SEQ ID NO: 31534
  Payload ID: 6174
  Gene Symbol: FRMPD1
  Gene Name: FERM and PDZ domain containing 1
  Uniprot ID: Q5SYB0
  ENSP ID: ENSP00000444411

SEQ ID NO: 31537 - protein, 1284 aa, Homo sapiens
  Payload ID: 6175
  Gene Symbol: FRMPD2
  Gene Name: FERM and PDZ domain containing 2
  Uniprot ID: Q68DX3
  ENSP ID: ENSP00000307079
MHVFIVGMSLSSVTLASALQVRGEALSEEEIWSLLFLAAEQLLEDLRNDSSDYVVCPWSALLSAAGSLSFQGRVSHIEAAPFKAPELLQGQSEDEQPDASQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 31538 - protein, 1309 aa, Homo sapiens
  Payload ID: 6175
  Gene Symbol: FRMPD2
  Gene Name: FERM and PDZ domain containing 2
  Uniprot ID: Q68DX3
  ENSP ID: ENSP00000363317
MQPLTKDAGMSLSSVTLASALQVRGEALSEEEIWSLLFLAAEQLLEDLRNDSSDYVVCPWSALLSAAGSLSFQGRVSHIEAAPFKAPELLQGQSEDEQPDASQMHVYSLGMTLYWSAGFHVPPHQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEQVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 31539 - protein, 261 aa, Homo sapiens
  Payload ID: 6175
  Gene Symbol: FRMPD2
  Gene Name: FERM and PDZ domain containing 2
  Uniprot ID: Q68DX3
  ENSP ID: ENSP00000422446
MGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 31540 - protein, 1810 aa, Homo sapiens
  Payload ID: 6176
  Gene Symbol: FRMPD3
  Gene Name: FERM and PDZ domain containing 3
  Uniprot ID: Q5JV73
  ENSP ID: ENSP00000276185
METLDSQRVQDRLLAAPGCSSPSGQQELFSSHVMQEESANDMECEQLPAEILRQVTVHRDPIYGFGFVAGSERPVVVRSVRPGGPSENKLLAGDQIVAINEEDVSEAPRERLIELIRSAKEFIVLTVLHTHQSPKSAFISAAKKAKLRSNPVKVRFSEQVAVGETDAKMMKKEALLLIPNVLKVFLENGQIKSFTFDGRTTVKDVMLTLQDRLSLRFIEHFALVLEYAGPEQNHKFLLLQDKQPLAYVVQRTHYHGMKCLFRISFFPKDPVELLRRDPAAFEYLYIQSRNDVIRERFGMDPKPEMLLGLAALHIYITVSATRPSQKISLKNVEKEWGLEPFLPPSLLQVIKEKNLRKSLSQQLKAHQTHPSCGTKGSAIQAKLQYLRILNELPTFTGVLFNTVGLDEKQSATTLLVGPRHGISHVIDLKTNLTTVLSEFSKISKIQLFRENQGVARVETSIMDAKPLVLLMEWPEATNFACLIAGYCRLLLDSRKMVFSRPASQPLPPPMIKADYMHSAHRPVTGGHLGKKESSYVGSVGTSPRKSSRCTPPPADSELVSFCYLHMREQRKEQESRTDVNENLIFFEETRPRTKSDPTSKSSGQGYEVVPDDFDAASLDHEPCASRARSYTLDNSLGAEALNFYCDSCKAKLQEQLGPRKGGKPGSSRDNIVDLMSLPPPGSEEEEEEEDETTSLLPAIAAPPPGFRDNSSDEDDPKRRAVQSQEQGRHLRGLLYDEIPVTLIDSVQTRTVRDHAQELDDALVSTLQALEALAASEDGPHPPPPQTAGLIVLATITPESSLDSGHETNSSELTDMSEMMSAMKQHQNTTYFLAQHLNKDSLLARKDLPFRIQSCAAQAVLTAPYSLGRPDPNPSLQPIATGQSPGPPGARRKLPQSEGQVQGERTYSLAVHPALSPQLSEQKNLSLLSPVPEDKGPGHTRAGLEMSLRAATSSLSEEQVSELRDNLPKEVRLSPKLILDPKSSVTPAIISAALQQVVHNKSLVTAGGALGNPPSRGERRLEASMGRPEVSMMSSSASKNLKFKISPSAPETSWNSQHQLGAEVSSSPRAPTGSRADSLHLSQQEDSLPVQNFPPKSYLLRTSRESVGKQATGEVAGKGGPVGGKPTLQKQGTISSQGEKAQLESTPKRSKLEETSLVPRATYPMALQSPSCQSRSHSPSCQPHGHSPSSQSRGQSPSCQPRGQSPLRSQAASRQVSTMPSRKLETTLNGAHSTSEGPAKPKSSRGPFRLRNLFSATFPTRQKKETDERQAQLQKVKQYELEFLEELLKPPSQGELPGTEYLQPPAPGRCSCQLRSSPVQQGPGMSREQRRSCDCKRICRGGRPQATQTPVPSLRGRERDRVLPSQRQPEAGPGVSLSSPINVQRIRSTSLESRECRSDPESGVSCLTTCASGGECLGAPNYRKLMRRYSISELDQGDRASLTSDVYPHPPLGMLPREAKEVEASLPIALGPKSRSLESPTLGDPSYVQVAPETKGPRQMAVFSLPEEVYRKPAELDEDSESSKCCSIRYCFYYRKCDMADDASDGKDELSYSIPMKILPGMKLDEQVVPVVSRTLQVLDAATCSSSSPEASRTQEIDLRVSTFEGSLAKINALRAHAYGLPDGFLAARLDTNELLTVLRQCVASPEARAPKPYVSQISEYKLELALKFKELRASCRRVANVDKSPTHMLAAITGSFQVLSSLIETFVRLVFIVRSEAQRQELLAKVEEVVRNYTFLLRAAEESTARNLNQQQQQQQQQQQQQQQQQQQQQQQQQQQVAAAAGAATEHPPGSPTSATVMSTFTHSLKTLIK

SEQ ID NO: 31541 - protein, 1758 aa, Homo sapiens
  Payload ID: 6176
  Gene Symbol: FRMPD3
  Gene Name: FERM and PDZ domain containing 3
  ENSP ID: ENSP00000398668
RQVTVHRDPIYGFGFVAGSERPVVVRSVRPGGPSENKLLAGDQIVAINEEDVSEAPRERLIELIRSAKEFIVLTVLHTHQSPKSAFISAAKKAKLRSNPVKVRFSEQVAVGETDAKMMKKEALLLIPNVLKVFLENGQIKSFTFDGRTTVKDVMLTLQDRLSLRFIEHFALVLEYAGPEQNHKFLLLQDKQPLAYVVQRTHYHGMKCLFRISFFPKDPVELLRRDPAAFEYLYIQSRNDVIRERFGMDPKPEMLLGLAALHIYITVSATRPSQKISLKNVEKEWGLEPFLPPSLLQVIKEKNLRKSLSQQLKAHQTHPSCGTKGSAIQAKLQYLRILNELPTFTGVLFNTVGLDEKQSATTLLVGPRHGISHVIDLKTNLTTVLSEFSKISKIQLFRENQGVARVETSIMDAKPLVLLMEWPEATNFACLIAGYCRLLLDSRKMVFSRPASQPLPPPMIKADYMHSAHRPVTGGHLGKKESSYVGSVGTSPRKSSRCTPPPADSELVSFCYLHMREQRKEQESRTDVNENLIFFEETRPRTKSDPTSKSSGQGYEVVPDDFDAASLDHEPCASRARSYTLDNSLGAEALNFYCDSCKAKLQEQLGPRKGGKPGSSRDNIVDLMSLPPPGSEEEEEEEDETTSLLPAIAAPPPGFRDNSSDEDDPKRRAVQSQEQGRHLRGLLYDEIPVTLIDSVQTRTVRDHAQELDDALVSTLQALEALAASEDGPHPPPPQTAGLIVLATITPESSLDSGHETNSSELTDMSEMMSAMKQHQNTTYFLAQHLNKDSLLARKDLPFRIQSCAAQAVLTAPYSLGRPDPNPSLQPIATGQSPGPPGARRKLPQSEGQVQGERTYSLAVHPALSPQLSEQKNLSLLSPVPEDKGPGHTRAGLEMSLRAATSSLSEEQVSELRDNLPKEVRLSPKLILDPKSSVTPAIISAALQQVVHNKSLVTAGGALGNPPSRGERRLEASMGRPEVSMMSSSASKNLKFKISPSAPETSWNSQHQLGAEVSSSPRAPTGSRADSLHLSQQEDSLPVQNFPPKSYLLRTSRESVGKQATGEVAGKGGPVGGKPTLQKQGTISSQGEKAQLESTPKRSKLEETSLVPRATYPMALQSPSCQSRSHSPSCQPHGHSPSSQSRGQSPSCQPRGQSPLRSQAASRQVSTMPSRKLETTLNGAHSTSEGPAKPKSSRGPFRLRNLFSATFPTRQKKETDERQAQLQKVKQYELEFLEELLKPPSQGELPGTEYLQPPAPGRCSCQLRSSPVQQGPGMSREQRRSCDCKRICRGGRPQATQTPVPSLRGRERDRVLPSQRQPEAGPGVSLSSPINVQRIRSTSLESRECRSDPESGVSCLTTCASGGECLGAPNYRKLMRRYSISELDQGDRASLTSDVYPHPPLGMLPREAKEVEASLPIALGPKSRSLESPTLGDPSYVQVAPETKGPRQMAVFSLPEEVYRKPAELDEDSESSKCCSIRYCFYYRKCDMADDASDGKDELSYSIPMKILPGMKLDEQVVPVVSRTLQVLDAATCSSSSPEASRTQEIDLRVSTFEGSLAKINALRAHAYGLPDGFLAARLDTNELLTVLRQCVASPEARAPKPYVSQISEYKLELALKFKELRASCRRVANVDKSPTHMLAAITGSFQVLSSLIETFVRLVFIVRSEAQRQELLAKVEEVVRNYTFLLRAAEESTARNLNQQQQQQQQQQQQQQQQQQQQQQQQQQQVAAAAGAATEHPPGSPTSATVMSTFTHSLKTLIK

SEQ ID NO: 31542 - protein, 1322 aa, Homo sapiens
  Payload ID: 6177
  Gene Symbol: FRMPD4
  Gene Name: FERM and PDZ domain containing 4
  Uniprot ID: Q14CM0
  ENSP ID: ENSP00000370057
MDVFSFVKIAKLSSHRTKSSGWPPPSGTWGLSQVPPYGWEMTANRDGRDYFINHMTQAIPFDDPRLESCQIIPPAPRKVEMRRDPVLGFGFVAGSEKPVVVRSVTPGGPSEGKLIPGDQIVMINDEPVSAAPRERVIDLVRSCKESILLTVIQPYPSPKSAFISAAKKARLKSNPVKVRFSEEVIINGQVSETVKDNSLLFMPNVLKVYLENGQTKSFRFDCSTSIKDVILTLQEKLSIKGIEHFSLMLEQRTEGAGTKLLLLHEQETLTQVTQRPSSHKMRCLFRISFVPKDPIDLLRRDPVAFEYLYVQSCNDVVQERFGPELKYDIALRLAALQMYIATVTTKQTQKISLKYIEKEWGLETFLPSAVLQSMKEKNIKKALSHLVKANQNLVPPGKKLSALQAKVHYLKFLSDLRLYGGRVFKATLVQAEKRSEVTLLVGPRYGISHVINTKTNLVALLADFSHVNRIEMFSEEESLVRVELHVLDVKPITLLMESSDAMNLACLTAGYYRLLVDSRRSIFNMANKKNTATQETGPENKGKHNLLGPDWNCIPQMTTFIGEGEQEAQITYIDSKQKTVEITDSTMCPKEHRHLYIDNAYSSDGLNQQLSQPGEAPCEADYRSLAQRSLLTLSGPETLKKAQESPRGAKVSFIFGDFALDDGISPPTLGYETLLDEGPEMLEKQRNLYIGSANDMKGLDLTPEAEGIQFVENSVYANIGDVKSFQAAEGIEEPLLHDICYAENTDDAEDEDEVSCEEDLVVGEMNQPAILNLSGSSDDIIDLTSLPPPEGDDNEDDFLLRSLNMAIAAPPPGFRDSSDEEDSQSQAASFPEDKEKGSSLQNDEIPVSLIDAVPTSAEGKCEKGLDNAVVSTLGALEALSVSEEQQTSDNSGVAILRAYSPESSSDSGNETNSSEMTESSELATAQKQSENLSRMFLATHEGYHPLAEEQTEFPASKTPAGGLPPKSSHALAARPATDLPPKVVPSKQLLHSDHMEMEPETMETKSVTDYFSKLHMGSVAYSCTSKRKSKLADGEGKAPPNGNTTGKKQQGTKTAEMEEEASGKFGTVSSRDSQHLSTFNLERTAFRKDSQRWYVATEGGMAEKSGLEAATGKTFPRASGLGAREAEGKEEGAPDGETSDGSGLGQGDRFLTDVTCASSAKDLDNPEDADSSTCDHPSKLPEADESVARLCDYHLAKRMSSLQSEGHFSLQSSQGSSVDAGCGTGSSGSACATPVESPLCPSLGKHLIPDASGKGVNYIPSEERAPGLPNHGATFKELHPQTEGMCPRMTVPALHTAINTEPLFGTLRDGCHRLPKIKETTV

SEQ ID NO: 31543 - protein, 1282 aa, Homo sapiens [sequence omitted]

SEQ ID NO: 31544 - protein, 549 aa, Homo sapiens
  Payload ID: 6178
  Gene Symbol: FRMD1
  Gene Name: FERM domain containing 1
  Uniprot ID: Q8N878
  ENSP ID: ENSP00000283309
MAVPPRGRGIDPARTNPDTFPPSGARCMEPSPERPACSQQEPTLGMDAMASEHRDVLVLLPSREQLRLAVGVKATGRELFQQVCNVASIRDAQFFGLCVVRNNEYIFMDLEQKLSKYFSKDWKKERNEGNEKPRAPFVAFLRVQHYVENGRVISDHRARHLYYCHLKERVLRSQCAHREEAYFLLAACALQADLGEHRESAHAGRYFEPHSYFPQWIITKRGIDYILRHMPTLHRERQGLSPKEAMLCFIQEACRLEDVPVHFFRLHKDKKEGRPTVILGLALRGVHIYQGKKLEIQLDGLPAAQKLVYYTGCTWRSRHLLHLLRASHQLHLRVRPTLQQLRQREEAEEKQHYRESYISDELELDLASRSFPGSGVSSQHCPHCLSRHSADSHGSSYTSGIKANSWLRESREMSVDVPLEVHGLHEKEPSSSPRTSRSHPSTRGDSQATRQEPCTQVRTRGQSAEAVHQIQEMTAGVSEEQHSHGLDDMQLHQLALHPAPTSLSHTFHRALDCRLAGPCETRATLPSKRSSNCLALDLFGEAPPQEFVV

SEQ ID NO: 31545 - protein, 481 aa, Homo sapiens
  Payload ID: 6178
  Gene Symbol: FRMD1
  Gene Name: FERM domain containing 1
  Uniprot ID: Q8N878
  ENSP ID: ENSP00000414115
MDDVKATGRELFQQVCNVASIRDAQFFGLCVVRNNEYIFMDLEQKLSKYFSKDWKKERNEGNEKPRAPFVAFLRVQHYVENGRVISDHRARHLYYCHLKERVLRSQCAHREEAYFLLAACALQADLGEHRESAHAGRYFEPHSYFPQWIITKRGIDYILRHMPTLHRERQGLSPKEAMLCFIQEACRLEDVPVHFFRLHKDKKEGRPTVILGLALRGVHIYQGKKLEIQLDGLPAAQKLVYYTGCTWRSRHLLHLLRASHQLHLRVRPTLQQLRQREEAEEKQHYRESYISDELELDLASRSFPGSGVSSQHCPHCLSRHSADSHGSSYTSGIKANSWLRESREMSVDVPLEVHGLHEKEPSSSPRTSRSHPSTRGDSQATRQEPCTQVRTRGQSAEAVHQIQEMTAGVSEEQHSHGLDDMQLHQLALHPAPTSLSHTFHRALDCRLAGPCETRATLPSKRSSNCLALDLFGEAPPQEFVV

SEQ ID NO: 31546 - protein, 180 aa, Homo sapiens
  Payload ID: 6178
  Gene Symbol: FRMD1
  Gene Name: FERM domain containing 1
  ENSP ID: ENSP00000423552
SRPEEERVGPRRTPGLSHEEIWAVVSSSSRPLPVHCPALTSRTWQASLFHHEQASREDKTFRGARCMEPSPERPACSQQEPTLGMDAMASEHRDVLVLLPSREQLRLAVGVKATGRELFQQVCNVASIRDAQFFGLCVVRNNEYIFMDLEQKLSKYFSKDWKKERNELLRPEGLSAGGLW

SEQ ID NO: 31547 - protein, 195 aa, Homo sapiens
  Payload ID: 6178
  Gene Symbol: FRMD1
  Gene Name: FERM domain containing 1
  ENSP ID: ENSP00000424439
METSRPEEERVGPRRTPGLSHEEIWAVVSSSSRPLPVHCPALTSRTWQASLFHHEQASREDKTFRGARCMEPSPERPACSQQEPTLGMDAMASEHRDVLVLLPSREQLRLAVGVKATGRELFQQVCNVASIRDAQFFGLCVVRNNEYIFMDLEQKLSKYFSKDWKKERNEGNEKPRAPFVAFLRVQHYVENGRVI

SEQ ID NO: 31548 - protein, 180 aa, Homo sapiens; identical to SEQ ID NO: 31546
  Payload ID: 6178
  Gene Symbol: FRMD1
  Gene Name: FERM domain containing 1
  ENSP ID: ENSP00000427668

SEQ ID NO: 31549 - protein, 597 aa, Homo sapiens
  Payload ID: 6179
  Gene Symbol: FRMD3
  Gene Name: FERM domain containing 3
  Uniprot ID: A2A2Y4
  ENSP ID: ENSP00000303508
MFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 31550 - protein, 213 aa, Homo sapiens
  Payload ID: 6179
  Gene Symbol: FRMD3
  Gene Name: FERM domain containing 3
  Uniprot ID: A2A2Y4
  ENSP ID: ENSP00000328615
MQAEETKGIGITSMAKCLVKIQTRRSLQLHMVNHCNSNVFVRLLRLGSKVTARNTGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 31551 - protein, 362 aa, Homo sapiens
  Payload ID: 6179
  Gene Symbol: FRMD3
  Gene Name: FERM domain containing 3
  Uniprot ID: A2A2Y4
  ENSP ID: ENSP00000365617
MVFRRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 31552 - protein, 556 aa, Homo sapiens
  Payload ID: 6179
  Gene Symbol: FRMD3
  Gene Name: FERM domain containing 3
  Uniprot ID: A2A2Y4
  ENSP ID: ENSP00000365621
MFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 31553 - protein, 140 aa, Homo sapiens
  Payload ID: 6179
  Gene Symbol: FRMD3
  Gene Name: FERM domain containing 3
  ENSP ID: ENSP00000412719
GTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRCVQKKICSCFGVTW

SEQ ID NO: 31554 - protein, 553 aa, Homo sapiens
  Payload ID: 6179
  Gene Symbol: FRMD3
  Gene Name: FERM domain containing 3
  Uniprot ID: A2A2Y4
  ENSP ID: ENSP00000484839
MQLSKRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 31555 - protein, 525 aa, Homo sapiens
  Payload ID: 6180
  Gene Symbol: FRMD4A
  Gene Name: FERM domain containing 4A
  ENSP ID: ENSP00000264546
MAAGLLGSEDPPWSWNLTCRALRTCQVRNIRVLQLLLKPWCISRAVYQMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKL

SEQ ID NO: 31556 - protein, 1039 aa, Homo sapiens
  Payload ID: 6180
  Gene Symbol: FRMD4A
  Gene Name: FERM domain containing 4A
  Uniprot ID: Q9P2Q2
  ENSP ID: ENSP00000350032
MAVQLVPDSALGLLMMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGEATENSPILDGSESPPHQSTDE

SEQ ID NO: 31557 - protein, 1024 aa, Homo sapiens
  Payload ID: 6180
  Gene Symbol: FRMD4A
  Gene Name: FERM domain containing 4A
  ENSP ID: ENSP00000351438
MTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGEATENSPILDGSESPPHQSTDE

SEQ ID NO: 31558 - protein, 72 aa, Homo sapiens
  Payload ID: 6180
  Gene Symbol: FRMD4A
  Gene Name: FERM domain containing 4A
  ENSP ID: ENSP00000473870
MAVQLVPDSALGLLMDRATHMTTEGGTWREDTFWWWRWPFRLLKSCLSHLCKNLRQRKKILLCSPTREEASD

SEQ ID NO: 31559 - protein, 53 aa, Homo sapiens
  Payload ID: 6180
  Gene Symbol: FRMD4A
  Gene Name: FERM domain containing 4A
  ENSP ID: ENSP00000474863
MAVQLVPDSALGLLMMESHCVVQAGGQWCHLGSLQSPISASRVQAILLLHPPE

SEQ ID NO: 31560 - protein, 77 aa, Homo sapiens
  Payload ID: 6180
  Gene Symbol: FRMD4A
  Gene Name: FERM domain containing 4A
  ENSP ID: ENSP00000487974
MAISQHQFYLDRKQSKSKIHAARSLSEIAIDLTETGTLKTSKLANMGSKGKIISGSSGSLLSSGSGARRHCILLPGS

SEQ ID NO: 31561 - protein, 35 aa, Homo sapiens
  Payload ID: 6180
  Gene Symbol: FRMD4A
  Gene Name: FERM domain containing 4A
  ENSP ID: ENSP00000488325
MAISQHQFYLDRKQSKSKIHAARSLSEIAIDLTET

SEQ ID NO: 31562 - protein, 229 aa, Homo sapiens
  Payload ID: 6180
  Gene Symbol: FRMD4A
  Gene Name: FERM domain containing 4A
  ENSP ID: ENSP00000488764
  MOD_RES (1)..(1): Any amino acid
XHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGSYNDSCFLDSSLYPELADVQWYGQEKAKPGTLV

SEQ ID NO: 31563 - protein, 1034 aa, Homo sapiens
  Payload ID: 6181
  Gene Symbol: FRMD4B
  Gene Name: FERM domain containing 4B
  Uniprot ID: Q9Y2L6
  ENSP ID: ENSP00000381549
MASVFMCGVEDLLFSGSRFVWNLTVSTLRRWYTERLRACHQVLRTWCGLQDVYQMTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDENARKDLKTLPAFPTKTLQEHPSLAYCEDRVIEHYLKIKGLTRGQAVVQYMKIVEALPTYGVHYYAVKDKQGLPWWLGISYKGIGQYDIQDKVKPRKLFQWKQLENLYFREKKFAVEVHDPRRISVSRRTFGQSGLFVQTWYANSSLIKSIWVMAISQHQFYLDRKQSKAKIPSARSLDEIAMDLTETGTQRASKLVTLETKSQFIMASNGSLISSGSQDSEVSEEQKREKILELKKKEKLLQEKLLKKVEELKKICLREAELTGKMPKEYPLNIGEKPPQVRRRVGTAFKLDDNLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASSYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 31564 - protein, 113 aa, Homo sapiens
  Payload ID: 6181
  Gene Symbol: FRMD4B
  Gene Name: FERM domain containing 4B
  ENSP ID: ENSP00000417550
MTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHK

SEQ ID NO: 31565 - protein, 80 aa, Homo sapiens
  Payload ID: 6181
  Gene Symbol: FRMD4B
  Gene Name: FERM domain containing 4B
  ENSP ID: ENSP00000417765
MTEGRHCQVHLLDDRRLELLVQPKLLARELLDLVASHFNLKEKEYFGITFIDDTPICLHFMQPDTLSEESFHFLQIISKE

SEQ ID NO: 31566 - protein, 142 aa, Homo sapiens
  Payload ID: 6181
  Gene Symbol: FRMD4B
  Gene Name: FERM domain containing 4B
  ENSP ID: ENSP00000418023
MTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDE

SEQ ID NO: 31567 - protein, 167 aa, Homo sapiens
  Payload ID: 6181
  Gene Symbol: FRMD4B
  Gene Name: FERM domain containing 4B
  ENSP ID: ENSP00000418373
MTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDENARKDLKTLPAFPTKTLQEHPSLAY

SEQ ID NO: 31568 - protein, 686 aa, Homo sapiens
  Payload ID: 6181
  Gene Symbol: FRMD4B
  Gene Name: FERM domain containing 4B
  ENSP ID: ENSP00000418682
MAISQHQFYLDRKQSKAKIPSARSLDEIAMDLTETGTQRASKLVTLETKSQFIMASNGSLISSGSQDSEVSEEQKREKILELKKKEKLLQEKLLKKVEELKKICLREAELTGKMPKEYPLNIGEKPPQVRRRVGTAFKLDDNLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASSYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 31569 - protein, 183 aa, Homo sapiens
  Payload ID: 6181
  Gene Symbol: FRMD4B
  Gene Name: FERM domain containing 4B
  ENSP ID: ENSP00000418962
RNANGRSPNNSDKTFLSKFSSQEITLVKPRFYIESISFLKDKTTVELFFLNAKACVHKGQIEVESETIFKLAAFILQEAKGDYTSDENARKDLKTLPAFPTKTLQEHPSLAYCEDRVIEHYLKIKGLTRGQAVVQYMKIVEALPTYGVHYYAVKDKQGLPWWLGISYKGIGQYDIQDKVKPRK

SEQ ID NO: 31570 - protein, 161 aa, Homo sapiens
  Payload ID: 6181
  Gene Symbol: FRMD4B
  Gene Name: FERM domain containing 4B
  ENSP ID: ENSP00000419869
MSRLFQWKQLENLYFREKKFAVEVHDPRRISVSRRTFGQSGLFVQTWYANSSLIKSIWVMAISQHQFYLDRKQSKAKIPSARSLDEIAMDLTETGTQRASKLVTLETKSQFIMASNGSLISSGSQDSEVSEEQKREKILELKKKEKLLQEKLLKKVEELKK

SEQ ID NO: 31571 - protein, 17 aa, Homo sapiens
  Payload ID: 6181
  Gene Symbol: FRMD4B
  Gene Name: FERM domain containing 4B
  ENSP ID: ENSP00000420735
MAISQHQFYLDRKQSKV

SEQ ID NO: 31572 - protein, 517 aa, Homo sapiens
  Payload ID: 6182
  Gene Symbol: FRMD5
  Gene Name: FERM domain containing 5
  ENSP ID: ENSP00000384142
MLSRLMSGSSRSLEREYSCTVRLLDDSEYTCTIQRDAKGQYLFDLLCHHLNLLEKDYFGIRFVDPDKQRHWLEFTKSVVKQLRSQPPFTMCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYVSQKEEKKIILTYFAPTPEACKHLWKCGIENQAFYKLEKSSQVRTVSSSNLFFKGSRFRYSGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQSGHLKGPPLQQQQHQGWGKSVPLV

SEQ ID NO: 31573 - protein, 216 aa, Homo sapiens
  Payload ID: 6182
  Gene Symbol: FRMD5
  Gene Name: FERM domain containing 5
  ENSP ID: ENSP00000392786
MLSRLMSGSSRSLEREYSCTVRLLDDSEYTCTIQRDAKGQYLFDLLCHHLNLLEKDYFGIRFVDPDKQRHWLEFTKSVVKQLRSQPPFTMCFRVKFYPADPAALKEEITRYLVFLQIKRDLYHGRLLCKTSDAALLAAYILQAEIGDYDSGKHPEGYSSKFQFFPKHSEKLERKIAEIHKTELRTCQEMLHFWPSLLLGLLFFKETRGSTSLNGMR

SEQ ID NO: 31574 - protein, 474 aa, Homo sapiens
  Payload ID: 6182
  Gene Symbol: FRMD5
  Gene Name: FERM domain containing 5
  ENSP ID: ENSP00000399684
RDAKGQYLFDLLCHHLNLLEKDYFGIRFVDPDKQRHWLEFTKSVVKQLRSQPPFTMCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYVSQKEEKKIILTYFAPTPEACKHLWKCGIENQAFYKLEKSSQVRTVSSSNLFFKGSRFRYSGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQAMVCLQNPLSGEPAH

SEQ ID NO: 31575 - protein, 123 aa, Homo sapiens
  Payload ID: 6182
  Gene Symbol: FRMD5
  Gene Name: FERM domain containing 5
  ENSP ID: ENSP00000401635
MLSRLMSGSSRSLEREYSCTVRLLDDSEYTCTIQRDAKGQYLFDLLCHHLNLLEKDYFGIRFVDPDKQRHWLEFTKSVVKQLRSQPPFTMCFRVKFYPADPAALKEEITSAVATEWTSFLQEV

SEQ ID NO: 31576 - protein, 570 aa, Homo sapiens
  Payload ID: 6182
  Gene Symbol: FRMD5
  Gene Name: FERM domain containing 5
  Uniprot ID: Q7Z6J6
  ENSP ID: ENSP00000403067
MLSRLMSGSSRSLEREYSCTVRLLDDSEYTCTIQRDAKGQYLFDLLCHHLNLLEKDYFGIRFVDPDKQRHWLEFTKSVVKQLRSQPPFTMCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYVSQKEEKKIILTYFAPTPEACKHLWKCGIENQAFYKLEKSSQVRTVSSSNLFFKGSRFRYSGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQVNKFVLSVLRLLLVTMGLLFVLLLLLIILTESDLDIAFFRDIRQTPEFEQFHYQYFCPLRRWFACKIRSVVSLLIDT

SEQ ID NO: 31577 - protein, 119 aa, Homo sapiens
  Payload ID: 6182
  Gene Symbol: FRMD5
  Gene Name: FERM domain containing 5
  ENSP ID: ENSP00000404496
  MOD_RES (1)..(1): Any amino acid
XMSGSSRSLEREYSCTVRLLDDSEYTCTIQRDAKGQYLFDLLCHHLNLLEKDYFGIRFVDPDKQRHWLEFTKSVVKQLRSQPPFTMCFRVKFYPADPAALKEEITSAVATEWTSFLQEV

SEQ ID NO: 31578 - protein, 414 aa, Homo sapiens
  Payload ID: 6182
  Gene Symbol: FRMD5
  Gene Name: FERM domain containing 5
  ENSP ID: ENSP00000452968
MCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYEKKIILTYFAPTPEACKHLWKCGIENQAFYKLEKSSQVRTVSSSNLFFKGSRFRYSGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQAMVCLQNPLSGEPAH

SEQ ID NO: 31579 - protein, 178 aa, Homo sapiens
  Payload ID: 6182
  Gene Symbol: FRMD5
  Gene Name: FERM domain containing 5
  ENSP ID: ENSP00000454031
FYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYVSQKEKKGIGSCPV

SEQ ID NO: 31580 - protein, 336 aa, Homo sapiens
  Payload ID: 6182
  Gene Symbol: FRMD5
  Gene Name: FERM domain containing 5
  ENSP ID: ENSP00000479575
MEWILTHVRNEVTKLKFEGKTFYLYVSQKEEKKIILTYFAPTPEACKHLWKCGIENQAFYKLEKSSQVRTVSSSNLFFKGSRFRYSGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQVNKFVLSVLRLLLVTMGLLFVLLLLLIILTESDLDIAFFRDIRQTPEFEQFHYQYFCPLRRWFACKIRSVVSLLIDT

SEQ ID NO: 31581 - protein, 622 aa, Homo sapiens
  Payload ID: 6183
  Gene Symbol: FRMD6
  Gene Name: FERM domain containing 6
  Uniprot ID: Q96NE9
  ENSP ID: ENSP00000343899
MNKLNFHNNRVMQDRRSVCIFLPNDESLNIIINVKILCHQLLVQVCDLLRLKDCHLFGLSVIQNNEHVYMELSQKLYKYCPKEWKKEASKVRQYEVTWGIDQFGPPMIIHFRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 31582 - protein, 614 aa, Homo sapiens
  Payload ID: 6183
  Gene Symbol: FRMD6
  Gene Name: FERM domain containing 6
  Uniprot ID: Q96NE9
  ENSP ID: ENSP00000348550
MNKLNFHNNRVMQDRRSVCIFLPNDESLNIIINVKILCHQLLVQVCDLLRLKDCHLFGLSVIQNNEHVYMELSQKLYKYCPKEWKKEASKGIDQFGPPMIIHFRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 31583 - protein, 614 aa, Homo sapiens; identical to SEQ ID NO: 31582
  Payload ID: 6183
  Gene Symbol: FRMD6
  Gene Name: FERM domain containing 6
  Uniprot ID: Q96NE9
  ENSP ID: ENSP00000379068

SEQ ID NO: 31584 - protein, 129 aa, Homo sapiens
  Payload ID: 6183
  Gene Symbol: FRMD6
  Gene Name: FERM domain containing 6
  ENSP ID: ENSP00000450667
FRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKV

SEQ ID NO: 31585 - protein, 143 aa, Homo sapiens
  Payload ID: 6183
  Gene Symbol: FRMD6
  Gene Name: FERM domain containing 6
  ENSP ID: ENSP00000450735
MDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEMLVDDPRDLEQMNEESLEVSPDMCIYITEDMLMSRKLNGHSGLIVKE

SEQ ID NO: 31586 - protein, 205 aa, Homo sapiens
  Payload ID: 6183
  Gene Symbol: FRMD6
  Gene Name: FERM domain containing 6
  ENSP ID: ENSP00000451157
DFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDGNSTVPSLALCLVSQFFQALVL

SEQ ID NO: 31587 - protein, 120 aa, Homo sapiens
  Payload ID: 6183
  Gene Symbol: FRMD6
  Gene Name: FERM domain containing 6
  ENSP ID: ENSP00000451453
MELSQKLYKYCPKEWKKEASKVRQYEVTWGIDQFGPPMIIHFRVQYYVENGRLISDRAARYYYYWHLRKQVLHSQCVLREEAYFLLAAFALQADLGNFKRNKHYGKYFEPEAYFPSWVVS

SEQ ID NO: 31588 - protein, 545 aa, Homo sapiens
  Payload ID: 6183
  Gene Symbol: FRMD6
  Gene Name: FERM domain containing 6
  ENSP ID: ENSP00000451977
MELSQKLYKYCPKEWKKEASKGIDQFGPPMIIHFRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 31589 - protein, 61 aa, Homo sapiens
  Payload ID: 6183
  Gene Symbol: FRMD6
  Gene Name: FERM domain containing 6
  ENSP ID: ENSP00000452122
MNKLNFHNNRVMQDRRSVCIFLPNDESLNIIINVKILCHQLLVQVCDLLRLKDCHLFGLSV

SEQ ID NO: 31590 - protein, 264 aa, Homo sapiens
  Payload ID: 6183
  Gene Symbol: FRMD6
  Gene Name: FERM domain containing 6
  Uniprot ID: Q96NE9
  ENSP ID: ENSP00000452529
MDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 31591 - protein, 714 aa, Homo sapiens
  Payload ID: 6184
  Gene Symbol: FRMD7
  Gene Name: FERM domain containing 7
  Uniprot ID: Q6ZUT3
  ENSP ID: ENSP00000298542
MLHLKVQFLDDSQKIFVVDQKSSGKALFNLSCSHLNLAEKEYFGLEFCSHSGNNVWLELLKPITKQVKNPKEIVFKFMVKFFPVDPGHLREELTRYLFTLQIKKDLALGRLPCSDNCTALMVSHILQSELGDFHEETDRKHLAQTRYLPNQDCLEGKIMHFHQKHIGRSPAESDILLLDIARKLDMYGIRPHPASDGEGMQIHLAVAHMGVLVLRGNTKINTFNWAKIRKLSFKRKHFLIKLHANILVLCKDTLEFTMASRDACKAFWKTCVEYHAFFRLSEEPKSKPKTLLCSKGSSFRYSGRTQRQLLEYGRKGRLKSLPFERKHYPSQYHERQCRSSPDLLSDVSKQVEDLRLAYGGGYYQNVNGVHASEPVLESRRRNSALEVTFATELEHSKPEADPTLLHQSQSSSSFPFIYMDPVFNTEPNPNPDPRDIFSERSSLSSFQTSCKFSGNHMSIYSGLTSKVRPAKQLTYTDVPYIPCTGQQVGIMPPQVFFYVDKPPQVPRWSPIRAEERTSPHSYVEPTAMKPAERSPRNIRMKSFQQDLQVLQEAIARTSGRSNINVGLEEEDPNLEDAFVCNIQEQTPKRSQSQSDMKTIRFPFGSEFRPLGPCPALSHKADLFTDMFAEQELPAVLMDQSTAERYVASESSDSESEILKPDYYALYGKEIRSPMARIRLSSGSLQLDEEDEDAYFNTPTAEDRTSLKPCNYFLA

SEQ ID NO: 31592 - protein, 594 aa, Homo sapiens
  Payload ID: 6184
  Gene Symbol: FRMD7
  Gene Name: FERM domain containing 7
  ENSP ID: ENSP00000359916
MVSHILQSELGDFHEETDRKHLAQTRYLPNQDCLEGKIMHFHQKHIGRSPAESDILLLDIARKLDMYGIRPHPASDGEGMQIHLAVAHMGVLVLRGNTKINTFNWAKIRKLSFKRKHFLIKLHANILVLCKDTLEFTMASRDACKAFWKTCVEYHAFFRLSEEPKSKPKTLLCSKGSSFRYSGRTQRQLLEYGRKGRLKSLPFERKHYPSQYHERQCRSSPDLLSDVSKQVEDLRLAYGGGYYQNVNGVHASEPVLESRRRNSALEVTFATELEHSKPEADPTLLHQSQSSSSFPFIYMDPVFNTEPNPNPDPRDIFSERSSLSSFQTSCKFSGNHMSIYSGLTSKVRPAKQLTYTDVPYIPCTGQQVGIMPPQVFFYVDKPPQVPRWSPIRAEERTSPHSYVEPTAMKPAERSPRNIRMKSFQQDLQVLQEAIARTSGRSNINVGLEEEDPNLEDAFVCNIQEQTPKRSQSQSDMKTIRFPFGSEFRPLGPCPALSHKADLFTDMFAEQELPAVLMDQSTAERYVASESSDSESEILKPDYYALYGKEIRSPMARIRLSSGSLQLDEEDEDAYFNTPTAEDRTSLKPCNYFLA

SEQ ID NO: 31593 - protein, 699 aa, Homo sapiens
  Payload ID: 6184
  Gene Symbol: FRMD7
  Gene Name: FERM domain containing 7
  Uniprot ID: Q6ZUT3
  ENSP ID: ENSP00000417996
MLHLKVQFLDDSQKIFVVDQKSSGKALFNLSCSHLNLAEKEYFGLEFCSHSGNNVWLELLKPITKQVKMDPGHLREELTRYLFTLQIKKDLALGRLPCSDNCTALMVSHILQSELGDFHEETDRKHLAQTRYLPNQDCLEGKIMHFHQKHIGRSPAESDILLLDIARKLDMYGIRPHPASDGEGMQIHLAVAHMGVLVLRGNTKINTFNWAKIRKLSFKRKHFLIKLHANILVLCKDTLEFTMASRDACKAFWKTCVEYHAFFRLSEEPKSKPKTLLCSKGSSFRYSGRTQRQLLEYGRKGRLKSLPFERKHYPSQYHERQCRSSPDLLSDVSKQVEDLRLAYGGGYYQNVNGVHASEPVLESRRRNSALEVTFATELEHSKPEADPTLLHQSQSSSSFPFIYMDPVFNTEPNPNPDPRDIFSERSSLSSFQTSCKFSGNHMSIYSGLTSKVRPAKQLTYTDVPYIPCTGQQVGIMPPQVFFYVDKPPQVPRWSPIRAEERTSPHSYVEPTAMKPAERSPRNIRMKSFQQDLQVLQEAIARTSGRSNINVGLEEEDPNLEDAFVCNIQEQTPKRSQSQSDMKTIRFPFGSEFRPLGPCPALSHKADLFTDMFAEQELPAVLMDQSTAERYVASESSDSESEILKPDYYALYGKEIRSPMARIRLSSGSLQLDEEDEDAYFNTPTAEDRTSLKPCNYFLA

SEQ ID NO: 31594 - protein, 464 aa, Homo sapiens
  Payload ID: 6185
  Gene Symbol: FRMD8
  Gene Name: FERM domain containing 8
  Uniprot ID: Q9BZ67
  ENSP ID: ENSP00000319726
MDGTEGSAGQPGPAERSHRSSVSSVGARAADVLVYLADDTVVPLAVENLPSLSAHELHRAVREVLQLPDIALDVFALWLVSPLLEVQLKPKHQPYKLGRQWPELLLRFTSAPDDDVAMDEPFLQFRRNVFFPKRRELQIHDEEVLRLLYEEAKGNVLAARYPCDVEDCEALGALVCRVQLGPYQPGRPAACDLREKLDSFLPAHLCKRGQSLFAALRGRGARAGPGEQGLLNAYRQVQEVSSDGGCEAALGTHYRAYLLKCHELPFYGCAFFHGEVDKPAQGFLHRGGRKPVSVAISLEGVHVIDSREKHVLLGLRFQELSWDHTSPEEEEPILWLEFDGDSEGTPVNKLLKIYSKQAELMSSLIEYCIELSQAAEPAGPQDSATGSPSDPSSSLAPVQRPKLRRQGSVVSSRIQHLSTIDYVEDGKGIRRVKPKRTTSFFSRQLSLGQGSYTVVQPGDSLEQG

SEQ ID NO: 31595 - protein, 408 aa, Homo sapiens
  Payload ID: 6185
  Gene Symbol: FRMD8
  Gene Name: FERM domain containing 8
  Uniprot ID: Q9BZ67
  ENSP ID: ENSP00000348270
MDGTEGSAGQPGPAERSHRSSVSSVGAREVQLKPKHQPYKLGRQWPELLLRFTSAPDDDVAMDEPFLQFRRNVFFPKRRELQIHDEEVLRLLYEEAKGNVLAARYPCDVEDCEALGALVCRVQLGPYQPGRPAACDLREKLDSFLPAHLCKRGQSLFAALRGRGARAGPGEQGLLNAYRQVQEVSSDGGCEAALGTHYRAYLLKCHELPFYGCAFFHGEVDKPAQGFLHRGGRKPVSVAISLEGVHVIDSREKHVLLGLRFQELSWDHTSPEEEEPILWLEFDGDSEGTPVNKLLKIYSKQAELMSSLIEYCIELSQAAEPAGPQDSATGSPSDPSSSLAPVQRPKLRRQGSVVSSRIQHLSTIDYVEDGKGIRRVKPKRTTSFFSRQLSLGQGSYTVVQPGDSLEQG

SEQ ID NO: 31596 - protein, 430 aa, Homo sapiens
  Payload ID: 6185
  Gene Symbol: FRMD8
  Gene Name: FERM domain containing 8
  Uniprot ID: Q9BZ67
  ENSP ID: ENSP00000392111
MDGTEGSAGQPGPAERSHRSSVSSVGARAADVLVYLADDTVVPLAVENLPSLSAHELHRAVREVLQLPDIALDVFALWLVSPLLDEPFLQFRRNVFFPKRRELQIHDEEVLRLLYEEAKGNVLAARYPCDVEDCEALGALVCRVQLGPYQPGRPAACDLREKLDSFLPAHLCKRGQSLFAALRGRGARAGPGEQGLLNAYRQVQEVSSDGGCEAALGTHYRAYLLKCHELPFYGCAFFHGEVDKPAQGFLHRGGRKPVSVAISLEGVHVIDSREKHVLLGLRFQELSWDHTSPEEEEPILWLEFDGDSEGTPVNKLLKIYSKQAELMSSLIEYCIELSQAAEPAGPQDSATGSPSDPSSSLAPVQRPKLRRQGSVVSSRIQHLSTIDYVEDGKGIRRVKPKRTTSFFSRQLSLGQGSYTVVQPGDSLEQG

SEQ ID NO: 31597 - protein, 66 aa, Homo sapiens
  Payload ID: 6185
  Gene Symbol: FRMD8
  Gene Name: FERM domain containing 8
  ENSP ID: ENSP00000433479
MDGTEGSAGQPGPAERSHRSSVSSVGARGGSHPHLLFHTLLGPQPWRSSSGLSSFSLKIIYVSTKK

SEQ ID NO: 31598 - protein, 90 aa, Homo sapiens
  Payload ID: 6185
  Gene Symbol: FRMD8
  Gene Name: FERM domain containing 8
  ENSP ID: ENSP00000434274
MDGTEGSAGQPGPAERSHRSSVSSVGARAADVLVYLADDTVVPLAVENLPSLSAHELHRAVREVLQLPDIALDVFALWLVSPLLEVQLKP

SEQ ID NO: 31599 - protein, 184 aa, Homo sapiens
  Payload ID: 6185
  Gene Symbol: FRMD8
  Gene Name: FERM domain containing 8
  ENSP ID: ENSP00000435913
MDGTEGSAGQPGPAERSHRSSVSSVGAREVQLKPKHQPYKLGRQWPELLLRFTSAPDDDVAMDEPFLQFRRNVFFPKRRELQIHDEEVLRLLYEEAKGNVLAARYPCDVEDCEALGALVCRVQLGPYQPGRPAACDLREKLDSFLPAHLCKRGQSLFAALRGRGARAGPGEQGLLNAYRQVQEV

SEQ ID NO: 31600 - protein, 155 aa, Homo sapiens
  Payload ID: 6185
  Gene Symbol: FRMD8
  Gene Name: FERM domain containing 8
  ENSP ID: ENSP00000435991
MDGTEGSAGQPGPAERSHRSSVSSVGARADDTVVPLAVENLPSLSAHELHRAVREVLQLPDIALDVFALWLVSPLLDEPFLQFRRNVFFPKRRELQIHDEEVLRLLYEEAKGNVLAARYPCDVEDCEALGALVCRVQLGPYQPGRPAACDLREKL

SEQ ID NO: 31601 - protein, 1045 aa, Homo sapiens
  Payload ID: 6186
  Gene Symbol: FARP1
  Gene Name: FERM, RhoGEF (ARHGEF) and pleckstrin domain protein 1 (chondrocyte-derived)
  Uniprot ID: Q9Y4F1
  ENSP ID: ENSP00000322926
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGREFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 31602 - protein, 129 aa, Homo sapiens
  Payload ID: 6186
  Gene Symbol: FARP1
  Gene Name: FERM, RhoGEF (ARHGEF) and pleckstrin domain protein 1 (chondrocyte-derived)
  Uniprot ID: Q9Y4F1
  ENSP ID: ENSP00000365765
MGEIEQRPTPGSRLGAPENSGISTLERGQKPPPTPSGKLVSIKIQMLDDTQEAFEVPMVSSSSFLKATGSSWTGWVLRCSMKPKHHSHLIEKFGEDRILTHLTGSISYTNWAGSRSLAVTVTEELLNLF

SEQ ID NO: 31603 - protein, 215 aa, Homo sapiens
  Payload ID: 6186
  Gene Symbol: FARP1
  Gene Name: FERM, RhoGEF (ARHGEF) and pleckstrin domain protein 1 (chondrocyte-derived)
  ENSP ID: ENSP00000410930
HLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGRVSSSGLTMHCAGSRKEASEGLTFEPFEERPLQSKMSSFHPPGRQLEKHNSVVSSESLCSEEIKQSSDLIFCFFSLRGDSLLYLFPYHIPQKI

SEQ ID NO: 31604 - protein, 248 aa, Homo sapiens
  Payload ID: 6186
  Gene Symbol: FARP1
  Gene Name: FERM, RhoGEF (ARHGEF) and pleckstrin domain protein 1 (chondrocyte-derived)
  ENSP ID: ENSP00000469365
  MOD_RES (1)..(1): Any amino acid
XEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGRFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHR

SEQ ID NO: 31605 - protein, 10 aa, Homo sapiens
  Payload ID: 6186
  Gene Symbol: FARP1
  Gene Name: FERM, RhoGEF (ARHGEF) and pleckstrin domain protein 1 (chondrocyte-derived)
  ENSP ID: ENSP00000469420
MYGIRLHPAK

SEQ ID NO: 31606 - protein, 203 aa, Homo sapiens
  Payload ID: 6186
  Gene Symbol: FARP1
  Gene Name: FERM, RhoGEF (ARHGEF) and pleckstrin domain protein 1 (chondrocyte-derived)
  ENSP ID: ENSP00000469712
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNH

SEQ ID NO: 31607 - protein, 1076 aa, Homo sapiens
  Payload ID: 6186
  Gene Symbol: FARP1
  Gene Name: FERM, RhoGEF (ARHGEF) and pleckstrin domain protein 1 (chondrocyte-derived)
  ENSP ID: ENSP00000471242
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGRPGSFSLIRTPHLGQARRIPCAPERRPLLLVKEFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 31608 - protein, 171 aa, Homo sapiens
  Payload ID: 6186
  Gene Symbol: FARP1
  Gene Name: FERM, RhoGEF (ARHGEF) and pleckstrin domain protein 1 (chondrocyte-derived)
  ENSP ID: ENSP00000472346
  MOD_RES (1)..(1): Any amino acid
XYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANFLGWPGARSRGRLHRETT

SEQ ID NO: 31609 - protein, 1076 aa, Homo sapiens; identical to SEQ ID NO: 31607
  Payload ID: 6186
  Gene Symbol: FARP1
  Gene Name: FERM, RhoGEF (ARHGEF) and pleckstrin domain protein 1 (chondrocyte-derived)
  ENSP ID: ENSP00000486285

SEQ ID NO: 31610 - protein, 1054 aa, Homo sapiens
  Payload ID: 6187
  Gene Symbol: FARP2
  Gene Name: FERM, RhoGEF and pleckstrin domain protein 2
  Uniprot ID: O94887
  ENSP ID: ENSP00000264042
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKEFTSYFQRHDEVLTELEKATKRCKKLEAVYKEFELQKVCYLPLNTFLLKPIQRLLHYRLLLRRLCGHYSPGHHDYADCHDALKAITEVTTTLQHILIRLENLQKLTELQRDLVGIENLIAPGREFIREGCLHKLTKKGLQQRMFFLFSDMLLYTSKGVAGTSHFRIRGLLPLQGMLVEESDNEWSVPHCFTIYAAQKTIVVAASTRLEKEKWMLDLNSAIQAAKSGGDTAPALPGRTVCTRPPRSPNEVSLEQESEDDARGVRSSLEGHGQHRANTTMHVCWYRNTSVSRADHSAAVENQLSGYLLRKFKNSHGWQKLWVVFTNFCLFFYKTHQDDYPLASLPLLGYSVSIPREADGIHKDYVFKLQFKSHVYFFRAESKYTFERWMEVIQGASSSAGRAPSIVQDGPQPSSGLEGMVRGKEE

SEQ ID NO: 31611 - protein, 647 aa, Homo sapiens
  Payload ID: 6187
  Gene Symbol: FARP2
  Gene Name: FERM, RhoGEF and pleckstrin domain protein 2
  Uniprot ID: O94887
  ENSP ID: ENSP00000362384
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKVFQLHEGHVAGVTKME

SEQ ID NO: 31612 - protein, 93 aa, Homo sapiens
  Payload ID: 6187
  Gene Symbol: FARP2
  Gene Name: FERM, RhoGEF and pleckstrin domain protein 2
  ENSP ID: ENSP00000388167
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQ

SEQ ID NO: 31613 - protein, 134 aa, Homo sapiens
  Payload ID: 6187
  Gene Symbol: FARP2
  Gene Name: FERM, RhoGEF and pleckstrin domain protein 2
  ENSP ID: ENSP00000393376
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEE

SEQ ID NO: 31614 - protein, 56 aa, Homo sapiens
  Payload ID: 6187
  Gene Symbol: FARP2
  Gene Name: FERM, RhoGEF and pleckstrin domain protein 2
  ENSP ID: ENSP00000403437
  MOD_RES (1)..(1): Any amino acid
XKSHVYFFRAESKYTFERWMEVIQGASSSAGRAPSIVQDGPQPSSGLEGMVRGKEE

SEQ ID NO: 31615 - protein, 79 aa, Homo sapiens
  Payload ID: 6187
  Gene Symbol: FARP2
  Gene Name: FERM, RhoGEF and pleckstrin domain protein 2
  ENSP ID: ENSP00000411353
  MOD_RES (1)..(1): Any amino acid
XFRSAVVKEDAMPATLMTLLFSNIDPIYEFHRGFLREVEQRLALWEGPSKAHTKGSHQRIGDILLRNMRQLKAAHEFTT

SEQ ID NO: 31616 - protein, 482 aa, Homo sapiens
  Payload ID: 6187
  Gene Symbol: FARP2
  Gene Name: FERM, RhoGEF and pleckstrin domain protein 2
  ENSP ID: ENSP00000412772
VEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGVGFCHVVSSCGSVCAGGQSFSALDLDTGRAGRELSAACKNDNGGDDFTTGSFPSGGEHRCDRQCRGGAPAFTLTNAQLQVSEEFIDDDPADISFFAGGSEAFSFPYGSVVPQESQASAQPLVAPPLCELPGSARSSPDRYSMEAVDMNTEDGFAFEEESDFNGNAHPSDTSELFEVKAQASRMQRLLGPSETSSLRNSQSENSSLNNMPLRGGLSVHTCSSASQSEASSMVNFPAYSVRSESSSAFQFSDIIDQLEQLSYPPTTAEDSSSTESDSWDSETEAPLDISLFFSNPFAHTSGERVPFDLQNNLKNLTPGEQIDKNPS

SEQ ID NO: 31617 - protein, 196 aa, Homo sapiens
  Payload ID: 6187
  Gene Symbol: FARP2
  Gene Name: FERM, RhoGEF and pleckstrin domain protein 2
  ENSP ID: ENSP00000415474
  MOD_RES (1)..(1): Any amino acid
XVEESDNEWSVPHCFTIYAAQKTIVVAASTRLEKEKWMLDLNSAIQAAKSGGDTAPALPGRTVCTRPPRSPNEVSLEQESEDDARGVRSSLEGHGQHRANTTMHVCWYRNTSVSRADHSAAVENQLSGYLLRKFKNSHGWQKLWVVFTNFCLFFYKTHQVDGGDPGGQQLSREGPKHRAGWPPTLLRAGGDGQGEG

SEQ ID NO: 31618 - protein, 638 aa, Homo sapiens
  Payload ID: 6187
  Gene Symbol: FARP2
  Gene Name: FERM, RhoGEF and pleckstrin domain protein 2
  Uniprot ID: O94887
  ENSP ID: ENSP00000486597
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKAAHEFTT

SEQ ID NO: 31619 - protein, 677 aa, Homo sapiens
  Payload ID: 6188
  Gene Symbol: FERMT1
  Gene Name: fermitin family member 1
  Uniprot ID: Q9BQL6
  ENSP ID: ENSP00000217289
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKRHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 31620 - protein, 146 aa, Homo sapiens
  Payload ID: 6188
  Gene Symbol: FERMT1
  Gene Name: fermitin family member 1
  ENSP ID: ENSP00000368121
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYF

SEQ ID NO: 31621 - protein, 420 aa, Homo sapiens
  Payload ID: 6188
  Gene Symbol: FERMT1
  Gene Name: fermitin family member 1
  ENSP ID: ENSP00000441063
MEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKRHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 31622 - protein, 680 aa, Homo sapiens
  Payload ID: 6189
  Gene Symbol: FERMT2
  Gene Name: fermitin family member 2
  Uniprot ID: Q96AC1
  ENSP ID: ENSP00000340391
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 31623 - protein, 687 aa, Homo sapiens
  Payload ID: 6189
  Gene Symbol: FERMT2
  Gene Name: fermitin family member 2
  Uniprot ID: Q96AC1
  ENSP ID: ENSP00000342858
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 31624 - protein, 680 aa, Homo sapiens; identical to SEQ ID NO: 31622
  Payload ID: 6189
  Gene Symbol: FERMT2
  Gene Name: fermitin family member 2
  Uniprot ID: Q96AC1
  ENSP ID: ENSP00000378993

SEQ ID NO: 31625 - protein, 633 aa, Homo sapiens
  Payload ID: 6189
  Gene Symbol: FERMT2
  Gene Name: fermitin family member 2
  Uniprot ID: Q96AC1
  ENSP ID: ENSP00000382243
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLITARILEAHQNVAQMSLIEAKMRFIQAWQSLPEFGITHFIARFQGGKKEELIGIAYNRLIRMDASTGDAIKTWRFSNMKQWNVNWEIKMVNS

SEQ ID NO: 31626 - protein, 153 aa, Homo sapiens
  Payload ID: 6189
  Gene Symbol: FERMT2
  Gene Name: fermitin family member 2
  ENSP ID: ENSP00000450506
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKK

SEQ ID NO: 31627 - protein, 640 aa, Homo sapiens
  Payload ID: 6189
  Gene Symbol: FERMT2
  Gene Name: fermitin family member 2
  ENSP ID: ENSP00000450741
SDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGTDVLYIGPLKGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 31628 - protein, 687 aa, Homo sapiens; identical to SEQ ID NO: 31623
  Payload ID: 6189
  Gene Symbol: FERMT2
  Gene Name: fermitin family member 2
  Uniprot ID: Q96AC1
  ENSP ID: ENSP00000451084

SEQ ID NO: 31629 - protein, 65 aa, Homo sapiens
  Payload ID: 6189
  Gene Symbol: FERMT2
  Gene Name: fermitin family member 2
  ENSP ID: ENSP00000451085
MALDGIRMPDGCYADGTWELSVHVTDLNRDVTLRVTGEVHIGGVMLKLVEKLEKRSPTRCKKRLV

SEQ ID NO: 31630 - protein, 133 aa, Homo sapiens
  Payload ID: 6189
  Gene Symbol: FERMT2
  Gene Name: fermitin family member 2
  ENSP ID: ENSP00000451134
  MOD_RES (1)..(1): Any amino acid
XFLKMQHLNPDPQLIPEQITTDITPECLVSPRYLKKYKNKQITARILEAHQNVAQMSLIEAKMRFIQAWQSLPEFGITHFIARFQGGKKEELIGIAYNRLIRMDASTGDAIKTWRFSNMKQWNVNWEIKMVNS

SEQ ID NO: 31631 - protein, 155 aa, Homo sapiens
  Payload ID: 6189
  Gene Symbol: FERMT2
  Gene Name: fermitin family member 2
  ENSP ID: ENSP00000451268
MKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLM

SEQ ID NO: 31632 - protein, 133 aa, Homo sapiens
  Payload ID: 6189
  Gene Symbol: FERMT2
  Gene Name: fermitin family member 2
  ENSP ID: ENSP00000452472
MWLLKVRKNVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGK

SEQ ID NO: 31633 - protein, 545 aa, Homo sapiens
  Payload ID: 6189
  Gene Symbol: FERMT2
  Gene Name: fermitin family member 2
  ENSP ID: ENSP00000489609
  MOD_RES (1)..(1): Any amino acid
XALELEGPLITPGSGTDVLYIGPLKGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQEKGCKKHMPGYIRDLITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 31634 - protein, 667 aa, Homo sapiens
  Payload ID: 6190
  Gene Symbol: FERMT3
  Gene Name: fermitin family member 3
  Uniprot ID: Q86UX7
  ENSP ID: ENSP00000279227
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRIPRRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 31635 - protein, 663 aa, Homo sapiens
  Payload ID: 6190
  Gene Symbol: FERMT3
  Gene Name: fermitin family member 3
  Uniprot ID: Q86UX7
  ENSP ID: ENSP00000339950
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 31636 - protein, 81 aa, Homo sapiens
  Payload ID: 6190
  Gene Symbol: FERMT3
  Gene Name: fermitin family member 3
  ENSP ID: ENSP00000438885
MPAHFSDSAQTEACYHMLSRPQPPPDPLLLQRLPRPSSLSDKTQLHSRWLDSSRCLMQQGIKAGDALWLRFKYYSFFDLDP

SEQ ID NO: 31637 - protein, 184 aa, Homo sapiens
  Payload ID: 6190
  Gene Symbol: FERMT3
  Gene Name: fermitin family member 3
  ENSP ID: ENSP00000440209
SSSMPAGWLAAAWPPKAAPWPTAATPARCRPSWPSSACSARAVGARATTPTALMPLPRASTPTASLPPVSSESSRPSRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 31638 - protein, 286 aa, Homo sapiens
  Payload ID: 6190
  Gene Symbol: FERMT3
  Gene Name: fermitin family member 3
  ENSP ID: ENSP00000445778
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDC

SEQ ID NO: 31639 - protein, 184 aa, Homo sapiens
  Payload ID: 6191
  Gene Symbol: FDX1
  Gene Name: ferredoxin 1
  Uniprot ID: P10109
  ENSP ID: ENSP00000260270
MAAAGGARLLRAASAVLGGPAGRWLHHAGSRAGSSGLLRNRGPGGSAEASRSLSVSARARSSSEDKITVHFINRDGETLTTKGKVGDSLLDVVVENNLDIDGFGACEGTLACSTCHLIFEDHIYEKLDAITDEENDMLDLAYGLTDRSRLGCQICLTKSMDNMTVRVPETVADARQSIDVGKTS

SEQ ID NO: 31640 - protein, 186 aa, Homo sapiens
  Payload ID: 6192
  Gene Symbol: FDX1L
  Gene Name: ferredoxin 1-like
  Uniprot ID: Q6P4F2
  ENSP ID: ENSP00000377311
MHVMAASMARGGVSARVLLQAARGTWWNRPGGTSGSGEGVALGTTRKFQATGSRPAGEEDAGGPERPGDVVNVVFVDRSGQRIPVSGRVGDNVLHLAQRHGVDLEGACEASLACSTCHVYVSEDHLDLLPPPEEREDDMLDMAPLLQENSRLGCQIVLTPELEGAEFTLPKITRNFYVDGHVPKPH

SEQ ID NO: 31641 - protein, 48 aa, Homo sapiens
  Payload ID: 6192
  Gene Symbol: FDX1L
  Gene Name: ferredoxin 1-like
  ENSP ID: ENSP00000467188
MLDMAPLLQENSRLGCQIVLTPELEGAEFTLPKITRNFYVDGHVPKPH

SEQ ID NO: 31642 - protein, 48 aa, Homo sapiens; identical to SEQ ID NO: 31641
  Payload ID: 6192
  Gene Symbol: FDX1L
  Gene Name: ferredoxin 1-like
  ENSP ID: ENSP00000488228

SEQ ID NO: 31643 - protein, 491 aa, Homo sapiens
  Payload ID: 6193
  Gene Symbol: FDXR
  Gene Name: ferredoxin reductase
  ENSP ID: ENSP00000293195
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 31644 - protein, 522 aa, Homo sapiens
  Payload ID: 6193
  Gene Symbol: FDXR
  Gene Name: ferredoxin reductase
  ENSP ID: ENSP00000408595
MASRCWRWWGWSAWPRTRLPPAGSTPTFGGSDEVRDPANAKALRNKRRRMQVRVKLGKFQLLLDIQEKTPQICVVGSGPAGFYTAQHLLKHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 31645 - protein, 451 aa, Homo sapiens
  Payload ID: 6193
  Gene Symbol: FDXR
  Gene Name: ferredoxin reductase
  Uniprot ID: P22570
  ENSP ID: ENSP00000414172
MASRCWRWWGWSAWPRTRLPPAGSTPSFCHHFSTQEKTPQICVVGSGPAGFYTAQHLLKQHPQAHVDIYEKQPVPFGLVRFGVAPDHPEVKSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 31646 - protein, 534 aa, Homo sapiens
  Payload ID: 6193
  Gene Symbol: FDXR
  Gene Name: ferredoxin reductase
  ENSP ID: ENSP00000416515
MASRCWRWWGWSAWPRTRLPPAGSTPSFCHHFSTQEKTPQICVVGSGPAGFYTAQHLLKRVEALCSQPRVLNSPALSGEGEDLGASQPLSLGPTSCHPVPQQHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 31647 - protein, 439 aa, Homo sapiens
  Payload ID: 6193
  Gene Symbol: FDXR
  Gene Name: ferredoxin reductase
  ENSP ID: ENSP00000445432
MEDKDREHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 31648 - protein, 46 aa, Homo sapiens
  Payload ID: 6193
  Gene Symbol: FDXR
  Gene Name: ferredoxin reductase
  ENSP ID: ENSP00000461993
MASRCWRWWGWSAWPRTRLPPAGSTPSRSRAPLGLDGSAGRPASAE

SEQ ID NO: 31649 - protein, 46 aa, Homo sapiens; identical to SEQ ID NO: 31648
  Payload ID: 6193
  Gene Symbol: FDXR
  Gene Name: ferredoxin reductase
  ENSP ID: ENSP00000462083

SEQ ID NO: 31650 - protein, 483 aa, Homo sapiens
  Payload ID: 6193
  Gene Symbol: FDXR
  Gene Name: ferredoxin reductase
  ENSP ID: ENSP00000462183
MASRCWRWWGWSAWPRTRLPPAGSTPSFCHHFSTQEKTPQICVVGSGPAGFYTAQHLLKHPQAHVDIYEKQPVPFGLVRFGVAPDHPEVKTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 31651 - protein, 91 aa, Homo sapiens
  Payload ID: 6193
  Gene Symbol: FDXR
  Gene Name: ferredoxin reductase
  ENSP ID: ENSP00000462330
MASRCWRWWGWSAWPRTRLPPAGSTPSFCHHFSTQEKTPQICVVGSGPAGFYTAQHLLKLPPCSPAAPPGPRGHLRETACALWPGALWCGA

SEQ ID NO: 31652 - protein, 46 aa, Homo sapiens; identical to SEQ ID NO: 31648
  Payload ID: 6193
  Gene Symbol: FDXR
  Gene Name: ferredoxin reductase
  ENSP ID: ENSP00000462488

SEQ ID NO: 31653 - protein, 46 aa, Homo sapiens
  Payload ID: 6193
  Gene Symbol: FDXR
  Gene Name: ferredoxin reductase
  ENSP ID: ENSP00000462884
  MOD_RES (1)..(1): Any amino acid
XASRCWRWWGWSAWPRTRLPPAGSTPSRSRAPLGLDGSAGRPASAE

SEQ ID NO: 31654 - protein, 497 aa, Homo sapiens
  Payload ID: 6193
  Gene Symbol: FDXR
  Gene Name: ferredoxin reductase
  ENSP ID: ENSP00000462972
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLEALLLCQRTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 31655 - protein, 164 aa, Homo sapiens
  Payload ID: 6193
  Gene Symbol: FDXR
  Gene Name: ferredoxin reductase
  ENSP ID: ENSP00000463308
MEDKDREQHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLERTDITKAALGVL

SEQ ID NO: 31656 - protein, 178 aa, Homo sapiens
  Payload ID: 6193
  Gene Symbol: FDXR
  Gene Name: ferredoxin reductase
  ENSP ID: ENSP00000463934
MASRCWRWWGWSAWPRTRLPPAGSTPSFCHHFSTQEKTPQICVVGSGPAGFYTAQHLLKRVEALCSQPRVLNSPALSGEGEDLGASQPLSLGPTSCHPVPQQHPQAHVDIYEKQPVPFGLVRFGVAPDHPEVKTAHSGRCAFWGNVEVGRDVTVPELQEAYHAVVLSYGAEDHRALEI

SEQ ID NO: 31657 - protein, 463 aa, Homo sapiens
  Payload ID: 6193
  Gene Symbol: FDXR
  Gene Name: ferredoxin reductase
  ENSP ID: ENSP00000463940
MASRCWRWWGWSAWPRTRLPPAGSTPSFCHHFSTQEKTPQICVVGSGPAGFYTAQHLLKQHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 31658 - protein, 76 aa, Homo sapiens
  Payload ID: 6193
  Gene Symbol: FDXR
  Gene Name: ferredoxin reductase
  ENSP ID: ENSP00000464670
MASRCWRWWGWSAWPRTRLPPAGSTPREDPPDLCGGQWPSWLLHGPTPAKAAPPGPRGHLRETACALWPGALWCGA

SEQ ID NO: 31659 - protein, 624 aa, Homo sapiens
  Payload ID: 6194
  Gene Symbol: FDXACB1
  Gene Name: ferredoxin-fold anticodon binding domain containing 1
  Uniprot ID: Q9BRP7
  ENSP ID: ENSP00000260257
MAPRRLLLVGEGNFSFAAALSETLDQSTQLTATCLQRPAELARDPLAWENLQCLRERGIDVRFGVDCTQLADVFELHEREFDQIYFIFPHCGRKAGVAKNRELLAKFFQSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGKLNRGFLEAPSCHPIKTINEKLIAELGKVFPLKRLKCSYPLLPQEGTSVLPFWNCDFLSAAFWISLHEDNSNSESLTGGTSQDVEDFLVSFSELSLLKNPGRDGKEEACEGTCGQAKICLRPSLLVHVQDVIEVPDFLSGSLHILSGPVFQKCHILPFTMPAFHETLFILGVNQNLKDGCLQSLLDHLKGILDSLLTQTLPESSKLSSLVKFVLQSNGKDYMIRVKTHNFSPDCTEDLIIGSVITSATSVIHKDQCFVFVSMNLDLLAMLVWCISDWRMLWTFDNRFLKNFVPGKIEPFKSHSLYPPCYVHDVSFWIDQKKGFDELEFHTVARAVSQDTIISIQFLSRFQHPKTQQVSLCYRLTYQTCDKALTQQQVASMQSQFRKEIQQHLYVIPR

SEQ ID NO: 31660 - protein, 105 aa, Homo sapiens
  Payload ID: 6194
  Gene Symbol: FDXACB1
  Gene Name: ferredoxin-fold anticodon binding domain containing 1
  ENSP ID: ENSP00000431629
MAPRRLLLVGEGNFSFAAALSETLDQSTQLTATCLQRPAELARDPLAWENLQCLRERAVQTFLQRKEKSTWHYVEDKVELLRISPRENGTTVGKWLPWQPWGGSF

SEQ ID NO: 31661 - protein, 396 aa, Homo sapiens
  Payload ID: 6194
  Gene Symbol: FDXACB1
  Gene Name: ferredoxin-fold anticodon binding domain containing 1
  ENSP ID: ENSP00000435572
MFLLPEGVLIQTPRDTRNNSSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGKLNRGFLEAPSCHPIKTINEKLIAELGKVFPLKRLKCSYPLLPQEGTSVLPFWNCDFLSAAFWISLHEDNSNSESLTGGTSQDVEDFLVSFSELSLLKNPGRDGKEEACEGTCGQAKICLRPSLLVHVQDVIEVPDFLSGSLHILSGPVFQKCHILPFTMPAFHETLFILGVNQNLKDGCLQSLLDHLKGILDSLLTQTLPESSKLSSLVKFVLQSNGKDYMIRVKTHNFSPDCTEDLIIGSVITSATSVIHKDQCFV

SEQ ID NO: 31662 - protein, 626 aa, Homo sapiens
  Payload ID: 6195
  Gene Symbol: FRRS1
  Gene Name: ferric-chelate reductase 1
  Uniprot ID: Q6ZNA5
  ENSP ID: ENSP00000287474
MAVSGFTLGTCILLLHISYVANYPNGKVTQSCHGMIPEHGHSPQSVPVHDIYVSQMTFRPGDQIEVTLSGHPFKGFLLEARNAEDLNGPPIGSFTLIDSEVSQLLTCEDIQGSAVSHRSASKKTEIKVYWNAPSSAPNHTQFLVTVVEKYKIYWVKIPGPIISQPNAFPFTTPKATVVPLPTLPPVSHLTKPFSASDCGNKKFCIRSPLNCDPEKEASCVFLSFTRDDQSVMVEMSGPSKGYLSFALSHDQWMGDDDAYLCIHEDQTVYIQPSHLTGRSHPVMDSRDTLEDMAWRLADGVMQCSFRRNITLPGVKNRFDLNTSYYIFLADGAANDGRIYKHSQQPLITYEKYDVTDSPKNIGGSHSVLLLKVHGALMFVAWMTTVSIGVLVARFFKPVWSKAFLLGEAAWFQVHRMLMFTTTVLTCIAFVMPFIYRGGWSRHAGYHPYLGCIVMTLAVLQPLLAVFRPPLHDPRRQMFNWTHWSMGTAARIIAVAAMFLGMDLPGLNLPDSWKTYAMTGFVAWHVGTEVVLELKYWMMTEFRSFSHLLQWKQRVMLLKRQCWQFMSVGMLLFSSYFYLQSTIYEQAKTLAFAGQVIIIIKPKKLEACPDCLEHICEFSLGRLGSCL

SEQ ID NO: 31663 - protein, 344 aa, Homo sapiens
  Payload ID: 6196
  Gene Symbol: FRRS1L
  Gene Name: ferric-chelate reductase 1-like
  Uniprot ID: Q9P0K9
  ENSP ID: ENSP00000477141
MRRPRQGGGGAGGSAAARARAGGLGGGSVPARARGAPAAARAAWLRDLCARMARPPRQHPGVWASLLLLLLTGPAACAASPADDGAGPGGRGPRGRARGDTGADEAVPRHDSSYGTFAGEFYDLRYLSEEGYPFPTAPPVDPFAKIKVDDCGKTKGCFRYGKPGCNAETCDYFLSYRMIGADVEFELSADTDGWVAVGFSSDKKMGGDDVMACVHDDNGRVRIQHFYNVGQWAKEIQRNPARDEEGVFENNRVTCRFKRPVNVPRDETIVDLHLSWYYLFAWGPAIQGSITRHDIDSPPASERVVSIYKYEDIFMPSAAYQTFSSPFCLLLIVALTFYLLMGTP

SEQ ID NO: 31664 - protein, 242 aa, Homo sapiens [sequence omitted]

SEQ ID NO: 31665 - protein, 183 aa, Homo sapiens
  Payload ID: 6198
  Gene Symbol: FTH1
  Gene Name: ferritin, heavy polypeptide 1
  Uniprot ID: P02794
  ENSP ID: ENSP00000273550
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 31666 - protein, 81 aa, Homo sapiens
  Payload ID: 6198
  Gene Symbol: FTH1
  Gene Name: ferritin, heavy polypeptide 1
  ENSP ID: ENSP00000431575
MTTASTSQVRQNYHQDSEAAINRQINLELYASYVYLSMPTGTPGHQGQKKSHRKIIPGRTLYVPDDLEESLPLSGPQFPCL

SEQ ID NO: 31667 - protein, 102 aa, Homo sapiens
  Payload ID: 6198
  Gene Symbol: FTH1
  Gene Name: ferritin, heavy polypeptide 1
  ENSP ID: ENSP00000431659
MTTASTSQVRQNYHQDSEAAINRQINLELYASYVYLSMVLVHLIHSQQGHLVTRDRRSPTERSSQAGPCMCLMTWRNLSLSLDLSFPACEMGRWVPACSLKD

SEQ ID NO: 31668 - protein, 95 aa, Homo sapiens
  Payload ID: 6198
  Gene Symbol: FTH1
  Gene Name: ferritin, heavy polypeptide 1
  ENSP ID: ENSP00000432223
MTTASTSQVRQNYHQDSEAAINRQINLELYASYVYLSMSYYFDRDDVALKNFAKYFLHQSHEEREHAEKLMKLQNQRGGRIFLQDIKTVMTGRAG

SEQ ID NO: 31669 - protein, 153 aa, Homo sapiens
  Payload ID: 6198
  Gene Symbol: FTH1
  Gene Name: ferritin, heavy polypeptide 1
  ENSP ID: ENSP00000433321
MTTASTSQSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 31670 - protein, 114 aa, Homo sapiens
  Payload ID: 6198
  Gene Symbol: FTH1
  Gene Name: ferritin, heavy polypeptide 1
  ENSP ID: ENSP00000433470
MTTASTSQVRQNYHQDSEAAINRQINLELYASYVYLSMSYYFDRDDVALKNFAKYFLHQSHEEREHAEKLMKLQNQRGGRIFLQDIKPTGTPGHQGQKKSHRKIIPGRTLYVPD

SEQ ID NO: 31671 - protein, 50 aa, Homo sapiens
  Payload ID: 6198
  Gene Symbol: FTH1
  Gene Name: ferritin, heavy polypeptide 1
  ENSP ID: ENSP00000434403
MTTASTSQVRQNYHQDSEAAINRQINLELYASYVYLSMIVTATCLWGSLV

SEQ ID NO: 31672 - protein, 113 aa, Homo sapiens
  Payload ID: 6198
  Gene Symbol: FTH1
  Gene Name: ferritin, heavy polypeptide 1
  ENSP ID: ENSP00000435111
MKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 31673 - protein, 58 aa, Homo sapiens
  Payload ID: 6198
  Gene Symbol: FTH1
  Gene Name: ferritin, heavy polypeptide 1
  ENSP ID: ENSP00000436947
MKLQNQRGGRIFLQDIKKPDCDDWESGLNAMECALHLEKNVNQSLLELHKLATDKNDP

SEQ ID NO: 31674 - protein, 183 aa, Homo sapiens; identical to SEQ ID NO: 31665
  Payload ID: 6198
  Gene Symbol: FTH1
  Gene Name: ferritin, heavy polypeptide 1
  Uniprot ID: P02794
  ENSP ID: ENSP00000484477

SEQ ID NO: 31675 - protein, 183 aa, Homo sapiens
  Payload ID: 6199
  Gene Symbol: FTHL17
  Gene Name: ferritin, heavy polypeptide-like 17
  Uniprot ID: Q9BXU8
  ENSP ID: ENSP00000368207
MATAQPSQVRQKYDTNCDAAINSHITLELYTSYLYLSMAFYFNRDDVALENFFRYFLRLSDDKMEHAQKLMRLQNLRGGHICLHDIRKPECQGWESGLVAMESAFHLEKNVNQSLLDLYQLAVEKGDPQLCHFLESHYLHEQVKTIKELGGYVSNLRKICSPEAGLAEYLFDKLTLGGRVKET

SEQ ID NO: 31676 - protein, 175 aa, Homo sapiens
  Payload ID: 6200
  Gene Symbol: FTL
  Gene Name: ferritin, light polypeptide
  Uniprot ID: P02792
  ENSP ID: ENSP00000366525
MSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 31677 - protein, 190 aa, Homo sapiens
  Payload ID: 6200
  Gene Symbol: FTL
  Gene Name: ferritin, light polypeptide
  ENSP ID: ENSP00000484043
MSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYSSKGSLSSTTKSLLSPATSEGPLAK

SEQ ID NO: 31678 - protein, 423 aa, Homo sapiens
  Payload ID: 6201
  Gene Symbol: FECH
  Gene Name: ferrochelatase
  Uniprot ID: P22830
  ENSP ID: ENSP00000262093
MRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 31679 - protein, 429 aa, Homo sapiens
  Payload ID: 6201
  Gene Symbol: FECH
  Gene Name: ferrochelatase
  Uniprot ID: P22830
  ENSP ID: ENSP00000372326
MRSLGANMAAALRAAGVLLRDPLASSSWRVCQPWRWKSGAAAAAVTTETAQHAQGAKPQVQPQKRYESNIRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 31680 - protein, 111 aa, Homo sapiens
  Payload ID: 6201
  Gene Symbol: FECH
  Gene Name: ferrochelatase
  ENSP ID: ENSP00000465243
MRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQKKHFSGC

SEQ ID NO: 31681 - protein, 143 aa, Homo sapiens
  Payload ID: 6201
  Gene Symbol: FECH
  Gene Name: ferrochelatase
  ENSP ID: ENSP00000465363
  MOD_RES (1)..(1): Any amino acid
XDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKVSTVLQSF

SEQ ID NO: 31682 - protein, 165 aa, Homo sapiens
  Payload ID: 6201
  Gene Symbol: FECH
  Gene Name: ferrochelatase
  ENSP ID: ENSP00000465717
MRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTVPNQRILSPTS

SEQ ID NO: 31683 - protein, 326 aa, Homo sapiens
  Payload ID: 6201
  Gene Symbol: FECH
  Gene Name: ferrochelatase
  ENSP ID: ENSP00000466263
MRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQVVNRGDPYPQEVSATVQKVMERLEYCNPYRLVWQSKVGPMPWLGPQTDESIKGLCERGRKNILLVPIAFTSDHIETLYELDIEYSQVLAKE

SEQ ID NO: 31684 - protein, 90 aa, Homo sapiens
  Payload ID: 6201
  Gene Symbol: FECH
  Gene Name: ferrochelatase
  ENSP ID: ENSP00000467461
MLNMGGPETLGDVHDFLLRLFLDRDLMTLPIQNKLAPFIAKRRTPKIQEQYRRIGGGSPIKIWTSKQGEGMVKLLDELSPNTAPHKYYIG

SEQ ID NO: 31685 - protein, 822 aa, Homo sapiens
  Payload ID: 6202
  Gene Symbol: FES
  Gene Name: FES proto-oncogene, tyrosine kinase
  Uniprot ID: P07332
  ENSP ID: ENSP00000331504
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSLPPPLQLIPEVQKPLHEQLWYHGAIPRAEVAELLVHSGDFLVRESQGKQEYVLSVLWDGLPRHFIIQSLDNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 31686 - protein, 764 aa, Homo sapiens
  Payload ID: 6202
  Gene Symbol: FES
  Gene Name: FES proto-oncogene, tyrosine kinase
  Uniprot ID: P07332
  ENSP ID: ENSP00000377837
MGFSSELCSPQGHGVLQQMQEAELRLLEGMRKWMAQRVKSDREYAGLLHHMSLQDSGGQSRAISPDSPISQTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSLPPPLQLIPEVQKPLHEQLWYHGAIPRAEVAELLVHSGDFLVRESQGKQEYVLSVLWDGLPRHFIIQSLDNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 31687 - protein, 681 aa, Homo sapiens
  Payload ID: 6202
  Gene Symbol: FES
  Gene Name: FES proto-oncogene, tyrosine kinase
  ENSP ID: ENSP00000377839
MGFSSELCSPQGHGVLQQMQEAELRLLEGMRKWMAQRVKSDREYAGLLHHMSLQDSGGQSRAISPDSPISQTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARSSPSTSSWSLCRGSSPPAGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 31688 - protein, 147 aa, Homo sapiens
  Payload ID: 6202
  Gene Symbol: FES
  Gene Name: FES proto-oncogene, tyrosine kinase
  ENSP ID: ENSP00000392696
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALAR

SEQ ID NO: 31689 - protein, 114 aa, Homo sapiens
  Payload ID: 6202
  Gene Symbol: FES
  Gene Name: FES proto-oncogene, tyrosine kinase
  ENSP ID: ENSP00000395425
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRK

SEQ ID NO: 31690 - protein, 752 aa, Homo sapiens
  Payload ID: 6202
  Gene Symbol: FES
  Gene Name: FES proto-oncogene, tyrosine kinase
  Uniprot ID: P07332
  ENSP ID: ENSP00000400868
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 31691 - protein, 42 aa, Homo sapiens
  Payload ID: 6202
  Gene Symbol: FES
  Gene Name: FES proto-oncogene, tyrosine kinase
  ENSP ID: ENSP00000410477
MGFSSELCSPQGHGVLQQMQEAELRLLEGMRKWMAQRVKSDR

SEQ ID NO: 31692 - protein, 694 aa, Homo sapiens
  Payload ID: 6202
  Gene Symbol: FES
  Gene Name: FES proto-oncogene, tyrosine kinase
  Uniprot ID: P07332
  ENSP ID: ENSP00000414629
MGFSSELCSPQGHGVLQQMQEAELRLLEGMRKWMAQRVKSDREYAGLLHHMSLQDSGGQSRAISPDSPISQTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 31693 - protein, 545 aa, Homo sapiens
  Payload ID: 6202
  Gene Symbol: FES
  Gene Name: FES proto-oncogene, tyrosine kinase
  ENSP ID: ENSP00000435811
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSLPPPLQLIPEVQKPLHEQLWYHGAIPRAEVAELLVHSGDFLVRESQGKQEYVLSVLWDGLPRHFIIQAHAPSEWRLLTPGPLPCRTCTDWKGKAFLAFLCSSTTY

SEQ ID NO: 31694 - protein, 169 aa, Homo sapiens
  Payload ID: 6202
  Gene Symbol: FES
  Gene Name: FES proto-oncogene, tyrosine kinase
  ENSP ID: ENSP00000454089
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALARDSAQAKRKYQEASKDKDRDKAK

SEQ ID NO: 31695 - protein, 121 aa, Homo sapiens
  Payload ID: 6202
  Gene Symbol: FES
  Gene Name: FES proto-oncogene, tyrosine kinase
  ENSP ID: ENSP00000454146
MGFSSELCSPQGHGVLQQMQEAELRLLEGMRKWMAQRVKSDREYAGLLHHMSLQDSGGQSRAISPDSPISQVGLYGTLVGAGCICLLLPLLGALWGSGWRSGRPMLGSHCAPLPASPICAV

SEQ ID NO: 31696 - protein, 183 aa, Homo sapiens
  Payload ID: 6203
  Gene Symbol: FATE1
  Gene Name: fetal and adult testis expressed 1
  Uniprot ID: Q969F0
  ENSP ID: ENSP00000359375
MAGGPPNTKAEMEMSLAEELNHGRQGENQEHLVIAEMMELGSRSRGASQKKQKLEQKAAGSASAKRVWNMTATRPKKMGSQLPKPRMLRESGHGDAHLQEYAGNFQGIRFHYDRNPGTDAVAQTSLEEFNVLEMEVMRRQLYAVNRRLRALEEQGATWRHRETLIIAVLVSASIANLWLWMNQ

SEQ ID NO: 31697 - protein, 80 aa, Homo sapiens
  Payload ID: 6203
  Gene Symbol: FATE1
  Gene Name: fetal and adult testis expressed 1
  ENSP ID: ENSP00000400493
KAEMEMSLAEELNHGRQGENQEHLVIAEMMELGSRSRGASQKKQKLEQKAAGSASAKRVWNMTATRPKKMQPRDRCSGAD

SEQ ID NO: 31698 - protein, 382 aa, Homo sapiens
  Payload ID: 6204
  Gene Symbol: FETUB
  Gene Name: fetuin B
  Uniprot ID: Q9UGM5
  ENSP ID: ENSP00000265029
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 31699 - protein, 317 aa, Homo sapiens
  Payload ID: 6204
  Gene Symbol: FETUB
  Gene Name: fetuin B
  ENSP ID: ENSP00000371569
MGLLLPLALCILVLCCGAMSPPQLALNPSALLSRGCNDSDVLAVAGFALRDINKDRKDGYVLRLNRVNDAQEYRRAISKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 31700 - protein, 345 aa, Homo sapiens
  Payload ID: 6204
  Gene Symbol: FETUB
  Gene Name: fetuin B
  Uniprot ID: Q9UGM5
  ENSP ID: ENSP00000371571
MGLLLPLALCILVLCCGAMSPPQLALNPSALLSRGCNDSDVLAVAGFALRDINKDRKDGYVLRLNRVNDAQEYRRVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 31701 - protein, 119 aa, Homo sapiens
  Payload ID: 6204
  Gene Symbol: FETUB
  Gene Name: fetuin B
  ENSP ID: ENSP00000393851
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESFQKKRFT

SEQ ID NO: 31702 - protein, 103 aa, Homo sapiens
  Payload ID: 6204
  Gene Symbol: FETUB
  Gene Name: fetuin B
  ENSP ID: ENSP00000396581
MTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVS

SEQ ID NO: 31703 - protein, 382 aa, Homo sapiens; identical to SEQ ID NO: 31698
  Payload ID: 6204
  Gene Symbol: FETUB
  Gene Name: fetuin B
  Uniprot ID: Q9UGM5
  ENSP ID: ENSP00000404288

SEQ ID NO: 31704 - protein, 92 aa, Homo sapiens
  Payload ID: 6204
  Gene Symbol: FETUB
  Gene Name: fetuin B
  ENSP ID: ENSP00000405438
MGLLLPLALCILVLCCGAMSPPQLALNPSALLSRGCNDSDVLAVAGFALRDINKDRKDGYVLRLNRVNDAQEYRRARWPGISVLSYTGCARD

SEQ ID NO: 31705 - protein, 238 aa, Homo sapiens
  Payload ID: 6205
  Gene Symbol: FEV
  Gene Name: FEV (ETS oncogene family)
  Uniprot ID: Q99581
  ENSP ID: ENSP00000295727
MRQSGASQPLLINMYLPDPVGDGLFKDGKNPSWGPLSPAVQKGSGQIQLWQFLLELLADRANAGCIAWEGGHGEFKLTDPDEVARRWGERKSKPNMNYDKLSRALRYYYDKNIMSKVHGKRYAYRFDFQGLAQACQPPPAHAHAAAAAAAAAAAAQDGALYKLPAGLAPLPFPGLSKLNLMAASAGVAPAGFSYWPGPGPAATAAAATAALYPSPSLQPPPGPFGAVAAASHLGGHYH

SEQ ID NO: 31706 - protein, 425 aa, Homo sapiens
  Payload ID: 6206
  Gene Symbol: FEZF1
  Gene Name: FEZ family zinc finger 1
  Uniprot ID: A0PJY2
  ENSP ID: ENSP00000392727
MDSSCHNATTKMLATAPARGNMMSTSKPLAFSIERIMARTPEPKALPVPHFLQGALPKGEPKHSLHLNSSIPCMIPFVPVAYDTSPKAGVTGSEPRKASLEAPAAPAAVPSAPAFSCSDLLNCALSLKGDLARDALPLQQYKLPKTYLAERNKLVVPAVEKYPSGVAFKDLSQAQLQHYMKESAQLLSEKIAFKTSDFSRGSPNAKPKVFTCEVCGKVFNAHYNLTRHMPVHTGARPFVCKVCGKGFRQASTLCRHKIIHTQEKPHKCNQCGKAFNRSSTLNTHTRIHAGYKPFVCEFCGKGFHQKGNYKNHKLTHSGEKQFKCNICNKAFHQVYNLTFHMHTHNDKKPFTCPTCGKGFCRNFDLKKHVRKLHDSSLGLARTPAGEPGTEPPPPLPQQPPMTLPPLQPPLPTPGPLQPGLHQGHQ

SEQ ID NO: 31707 - protein, 35 aa, Homo sapiens
  Payload ID: 6206
  Gene Symbol: FEZF1
  Gene Name: FEZ family zinc finger 1
  ENSP ID: ENSP00000406919
MDSSCHNATTKMLATAPARGNMMSTSKPLAFSIER

SEQ ID NO: 31708 - protein, 475 aa, Homo sapiens
  Payload ID: 6206
  Gene Symbol: FEZF1
  Gene Name: FEZ family zinc finger 1
  Uniprot ID: A0PJY2
  ENSP ID: ENSP00000411145
MDSSCHNATTKMLATAPARGNMMSTSKPLAFSIERIMARTPEPKALPVPHFLQGALPKGEPKHSLHLNSSIPCMIPFVPVAYDTSPKAGVTGSEPRKASLEAPAAPAAVPSAPAFSCSDLLNCALSLKGDLARDALPLQQYKLVRPRVVNHSSFHAMGALCYLNRGDGPCHPAAGVNIHPVASYFLSSPLHPQPKTYLAERNKLVVPAVEKYPSGVAFKDLSQAQLQHYMKESAQLLSEKIAFKTSDFSRGSPNAKPKVFTCEVCGKVFNAHYNLTRHMPVHTGARPFVCKVCGKGFRQASTLCRHKIIHTQEKPHKCNQCGKAFNRSSTLNTHTRIHAGYKPFVCEFCGKGFHQKGNYKNHKLTHSGEKQFKCNICNKAFHQVYNLTFHMHTHNDKKPFTCPTCGKGFCRNFDLKKHVRKLHDSSLGLARTPAGEPGTEPPPPLPQQPPMTLPPLQPPLPTPGPLQPGLHQGHQ

SEQ ID NO: 31709 - protein, 459 aa, Homo sapiens
  Payload ID: 6207
  Gene Symbol: FEZF2
  Gene Name: FEZ family zinc finger 2
  Uniprot ID: Q8TBJ5
  ENSP ID: ENSP00000283268
MASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLPASGSLYYFNYLDSTAYPPSELLSGHLFPSGLLNAQAPAALAAHPKLFLLENAKLAGLAADKFPHPAPYPHKERLPAPLEQVLKENSALTAERGGVKGHSKLPGGSADGKPKNFTCEVCGKVFNAHYNLTRHMPVHTGARPFVCKVCGKGFRQASTLCRHKIIHTQEKPHKCNQCGKAFNRSSTLNTHIRIHAGYKPFVCEFCGKGFHQKGNYKNHKLTHSGEKQYKCTICNKAFHQVYNLTFHMHTHNDKKPFTCATCGKGFCRNFDLKKHVRKLHDSVGPAAPSAKDLTRTVQS

SEQ ID NO: 31710 - protein, 459 aa, Homo sapiens; identical to SEQ ID NO: 31709
  Payload ID: 6207
  Gene Symbol: FEZF2
  Gene Name: FEZ family zinc finger 2
  Uniprot ID: Q8TBJ5
  ENSP ID: ENSP00000418589

SEQ ID NO: 31711 - protein, 459 aa, Homo sapiens; identical to SEQ ID NO: 31709
  Payload ID: 6207
  Gene Symbol: FEZF2
  Gene Name: FEZ family zinc finger 2
  Uniprot ID: Q8TBJ5
  ENSP ID: ENSP00000418804

SEQ ID NO: 31712 - protein, 379 aa, Homo sapiens
  Payload ID: 6208
  Gene Symbol: FGFR1OP
  Gene Name: FGFR1 oncogene partner
  Uniprot ID: O95684
  ENSP ID: ENSP00000230248
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 31713 - protein, 399 aa, Homo sapiens
  Payload ID: 6208
  Gene Symbol: FGFR1OP
  Gene Name: FGFR1 oncogene partner
  Uniprot ID: O95684
  ENSP ID: ENSP00000355812
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKIPRYKGQGKKKTSGQKAGDKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 31714 - protein, 351 aa, Homo sapiens
  Payload ID: 6208
  Gene Symbol: FGFR1OP
  Gene Name: FGFR1 oncogene partner
  ENSP ID: ENSP00000479115
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKTITQLECLLSIGALHFKNTADIF

SEQ ID NO: 31715 - protein, 253 aa, Homo sapiens
  Payload ID: 6209
  Gene Symbol: FGFR1OP2
  Gene Name: FGFR1 oncogene partner 2
  Uniprot ID: Q9NVK5
  ENSP ID: ENSP00000229395
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKIDMVHRNKSEGFFLDASRHILEAPQHGLERRHLEANQNELQAHVDQITEMAAVMRKAIEIDEQQGCKEQERIFQLEQENKGLREILQITRESFLNLRKDDASESTSLSALVTNSDLSLRKS

SEQ ID NO: 31716 - protein, 215 aa, Homo sapiens
  Payload ID: 6209
  Gene Symbol: FGFR1OP2
  Gene Name: FGFR1 oncogene partner 2
  Uniprot ID: Q9NVK5
  ENSP ID: ENSP00000323763
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKELQAHVDQITEMAAVMRKAIEIDEQQGCKEQERIFQLEQENKGLREILQITRESFLNLRKDDASESTSLSALVTNSDLSLRKS

SEQ ID NO: 31717 - protein, 172 aa, Homo sapiens
  Payload ID: 6209
  Gene Symbol: FGFR1OP2
  Gene Name: FGFR1 oncogene partner 2
  Uniprot ID: Q9NVK5
  ENSP ID: ENSP00000437556
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKIDMVHRNKSEGFFLDASRHILEAPQHGLERRHLEANQNVH

SEQ ID NO: 31718 - protein, 60 aa, Homo sapiens
  Payload ID: 6209
  Gene Symbol: FGFR1OP2
  Gene Name: FGFR1 oncogene partner 2
  ENSP ID: ENSP00000441144
MSCTIEKALADAKALVERLRDHDDAAESLIEQTTALNKRVEAMKQYQEEIQELNEVARHR

SEQ ID NO: 31719 - protein, 174 aa, Homo sapiens
  Payload ID: 6210
  Gene Symbol: FOPNL
  Gene Name: FGFR1OP N-terminal like
  Uniprot ID: Q96NB1
  ENSP ID: ENSP00000255759
MATVAELKAVLKDTLEKKGVLGHLKARIRAEVFNALDDDREPRPSLSHENLLINELIREYLEFNKYKYTASVLIAESGQPVVPLDRQFLIHELNAFEESKDNTIPLLYGILAHFLRGTKDGIQNAFLKGPSLQPSDPSLGRQPSRRKPMDDHLRKEEQKSTNIEDLHVSQAVNR

SEQ ID NO: 31720 - protein, 82 aa, Homo sapiens
  Payload ID: 6210
  Gene Symbol: FOPNL
  Gene Name: FGFR1OP N-terminal like
  ENSP ID: ENSP00000458159
MATVAELKAVLKDTLEKKGVLGHLKARIRAEVFNALDDDREPRPSLSHENLLINELIREYLEFNKYKYTASVLIADLFYMGF

SEQ ID NO: 31721 - protein, 124 aa, Homo sapiens
  Payload ID: 6210
  Gene Symbol: FOPNL
  Gene Name: FGFR1OP N-terminal like
  ENSP ID: ENSP00000458348
MATVAELKADDDREPRPSLSHENLLINELIREYLEFNKYKYTASVLIAESGQPVVPLDRQFLIHELNAFEESKDNTIPLLYGILAHFLRGTKDGIQNAFLKGPSLQPSDPSLGRQPSRRKPMGM

SEQ ID NO: 31722 - protein, 108 aa, Homo sapiens
  Payload ID: 6210
  Gene Symbol: FOPNL
  Gene Name: FGFR1OP N-terminal like
  ENSP ID: ENSP00000459429
MATVAELKAESGQPVVPLDRQFLIHELNAFEESKDNTIPLLYGILAHFLRGTKDGIQNAFLKGPSLQPSDPSLGRQPSRRKPMDDHLRKEEQKSTNIEDLHVSQAVNR

SEQ ID NO: 31723 - protein, 104 aa, Homo sapiens
  Payload ID: 6210
  Gene Symbol: FOPNL
  Gene Name: FGFR1OP N-terminal like
  ENSP ID: ENSP00000459804
MATVAELKAVLKDTLEKKGVLGHLKARIRAEVFNALDDDREPRPSLSHENLLINELIREYLEFNKYKYTASVLIAESGQPVVPLDRQFLIHELNAFEESKDNTI

SEQ ID NO: 31724 - protein, 100 aa, Homo sapiens
  Payload ID: 6210
  Gene Symbol: FOPNL
  Gene Name: FGFR1OP N-terminal like
  Uniprot ID: Q96NB1
  ENSP ID: ENSP00000460312
MATVAELKAVLKDTLEKKGVLGHLKARIRAEVFNALDDDREPRPSLSHENLLINELIREYLEFNKYKYTASVLIADDHLRKEEQKSTNIEDLHVSQAVNR

SEQ ID NO: 31725 - protein, 124 aa, Homo sapiens
  Payload ID: 6210
  Gene Symbol: FOPNL
  Gene Name: FGFR1OP N-terminal like
  ENSP ID: ENSP00000460592
MATVAELKAVLKDTLEKKGVLGHLKARIRAEVFNALDDDREPRPSLSHENLLINELIREYLEFNKYKYTASVLIADGVSLYCDLSSLHPPPPGFKQFSCLSLPSTWNYRIWSTCSSVGQTVSHP

SEQ ID NO: 31726 - protein, 128 aa, Homo sapiens
  Payload ID: 6210
  Gene Symbol: FOPNL
  Gene Name: FGFR1OP N-terminal like
  ENSP ID: ENSP00000461548
MATVAELKAVLKDTLEKKGVLGHLKARIRAEVFNALDDDREPRPSLSHENLLINELIREYLEFNKYKYTASVLIAAHCILRLLGSSSSPASASRVPGTTESGQPVVPLDRQFLIHELNAFEESKDNTI

SEQ ID NO: 31727 - protein, 198 aa, Homo sapiens
  Payload ID: 6210
  Gene Symbol: FOPNL
  Gene Name: FGFR1OP N-terminal like
  ENSP ID: ENSP00000461830
MATVAELKAVLKDTLEKKGVLGHLKARIRAEVFNALDDDREPRPSLSHENLLINELIREYLEFNKYKYTASVLIAAHCILRLLGSSSSPASASRVPGTTESGQPVVPLDRQFLIHELNAFEESKDNTIPLLYGILAHFLRGTKDGIQNAFLKGPSLQPSDPSLGRQPSRRKPMDDHLRKEEQKSTNIEDLHVSQAVNR

SEQ ID NO: 31728 - protein, 174 aa, Homo sapiens; identical to SEQ ID NO: 31719
  Payload ID: 6210
  Gene Symbol: FOPNL
  Gene Name: FGFR1OP N-terminal like
  Uniprot ID: Q96NB1
  ENSP ID: ENSP00000481290

SEQ ID NO: 31729 - protein, 124 aa, Homo sapiens; identical to SEQ ID NO: 31725
  Payload ID: 6210
  Gene Symbol: FOPNL
  Gene Name: FGFR1OP N-terminal like
  ENSP ID: ENSP00000487858

SEQ ID NO: 31730 - protein, 198 aa, Homo sapiens; identical to SEQ ID NO: 31727
  Payload ID: 6210
  Gene Symbol: FOPNL
  Gene Name: FGFR1OP N-terminal like
  ENSP ID: ENSP00000488051

SEQ ID NO: 31731 - protein, 128 aa, Homo sapiens; identical to SEQ ID NO: 31726
  Payload ID: 6210
  Gene Symbol: FOPNL
  Gene Name: FGFR1OP N-terminal like
  ENSP ID: ENSP00000488284

SEQ ID NO: 31732 - protein, 100 aa, Homo sapiens; identical to SEQ ID NO: 31724
  Payload ID: 6210
  Gene Symbol: FOPNL
  Gene Name: FGFR1OP N-terminal like
  Uniprot ID: Q96NB1
  ENSP ID: ENSP00000488488

SEQ ID NO: 31733 - protein, 104 aa, Homo sapiens; identical to SEQ ID NO: 31723
  Payload ID: 6210
  Gene Symbol: FOPNL
  Gene Name: FGFR1OP N-terminal like
  ENSP ID: ENSP00000488499

SEQ ID NO: 31734 - protein, 108 aa, Homo sapiens; identical to SEQ ID NO: 31722
  Payload ID: 6210
  Gene Symbol: FOPNL
  Gene Name: FGFR1OP N-terminal like
  ENSP ID: ENSP00000488552

SEQ ID NO: 31735 - protein, 82 aa, Homo sapiens; identical to SEQ ID NO: 31720
  Payload ID: 6210
  Gene Symbol: FOPNL
  Gene Name: FGFR1OP N-terminal like
  ENSP ID: ENSP00000488765

SEQ ID NO: 31736 - protein, 124 aa, Homo sapiens; identical to SEQ ID NO: 31721
  Payload ID: 6210
  Gene Symbol: FOPNL
  Gene Name: FGFR1OP N-terminal like
  ENSP ID: ENSP00000488883

SEQ ID NO: 31737 - protein, 551 aa, Homo sapiens
  Payload ID: 6211
  Gene Symbol: FGGY
  Gene Name: FGGY carbohydrate kinase domain containing
  Uniprot ID: Q96C11
  ENSP ID: ENSP00000305922
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 31738 - protein, 252 aa, Homo sapiens
  Payload ID: 6211
  Gene Symbol: FGGY
  Gene Name: FGGY carbohydrate kinase domain containing
  Uniprot ID: Q96C11
  ENSP ID: ENSP00000360254
MGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 31739 - protein, 463 aa, Homo sapiens
  Payload ID: 6211
  Gene Symbol: FGGY
  Gene Name: FGGY carbohydrate kinase domain containing
  Uniprot ID: Q96C11
  ENSP ID: ENSP00000360256
MSGGEQKPERYYVGVDVGTGSVRAALVDQSGVLLAFADQPIKNWEPQFNHHEQSSEDIWAACCVVTKNLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 31740 - protein, 575 aa, Homo sapiens
  Payload ID: 6211
  Gene Symbol: FGGY
  Gene Name: FGGY carbohydrate kinase domain containing
  Uniprot ID: Q96C11
  ENSP ID: ENSP00000360262
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMRTTGYLYIPALAALHSPSSLLSPQVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 31741 - protein, 507 aa, Homo sapiens
  Payload ID: 6211
  Gene Symbol: FGGY
  Gene Name: FGGY carbohydrate kinase domain containing
  ENSP ID: ENSP00000403425
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQWGK

SEQ ID NO: 31742 - protein, 184 aa, Homo sapiens
  Payload ID: 6211
  Gene Symbol: FGGY
  Gene Name: FGGY carbohydrate kinase domain containing
  ENSP ID: ENSP00000406607
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTA

SEQ ID NO: 31743 - protein, 54 aa, Homo sapiens
  Payload ID: 6211
  Gene Symbol: FGGY
  Gene Name: FGGY carbohydrate kinase domain containing
  ENSP ID: ENSP00000463260
MSGGEQKPERYYVGVDVGTGSVRAALVDQSGVLLAFADQPIKNWEPQFNHHEQS

SEQ ID NO: 31744 - protein, 249 aa, Homo sapiens
  Payload ID: 6211
  Gene Symbol: FGGY
  Gene Name: FGGY carbohydrate kinase domain containing
  ENSP ID: ENSP00000489030
MWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARSPD

SEQ ID NO: 31745 - protein, 112 aa, Homo sapiens
  Payload ID: 6211
  Gene Symbol: FGGY
  Gene Name: FGGY carbohydrate kinase domain containing
  ENSP ID: ENSP00000489146
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEELERDLLG

SEQ ID NO: 31746 - protein, 128 aa, Homo sapiens
  Payload ID: 6211
  Gene Symbol: FGGY
  Gene Name: FGGY carbohydrate kinase domain containing
  ENSP ID: ENSP00000489345
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGLSAPWCVSGHIQQRKAGTTVSGK

SEQ ID NO: 31747 - protein, 463 aa, Homo sapiens; identical to SEQ ID NO: 31739
  Payload ID: 6211
  Gene Symbol: FGGY
  Gene Name: FGGY carbohydrate kinase domain containing
  ENSP ID: ENSP00000489417

SEQ ID NO: 31748 - protein, 514 aa, Homo sapiens
  Payload ID: 6211
  Gene Symbol: FGGY
  Gene Name: FGGY carbohydrate kinase domain containing
  ENSP ID: ENSP00000489446
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQIRKTKHRAIK

SEQ ID NO: 31749 - protein, 153 aa, Homo sapiens
  Payload ID: 6211
  Gene Symbol: FGGY
  Gene Name: FGGY carbohydrate kinase domain containing
  ENSP ID: ENSP00000489549
MIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARSPD

SEQ ID NO: 31750 - protein, 529 aa, Homo sapiens
  Payload ID: 6212
  Gene Symbol: FGR
  Gene Name: FGR proto-oncogene, Src family tyrosine kinase
  Uniprot ID: P09769
  ENSP ID: ENSP00000363115
MGCVFCKKLEPVATAKEDAGLEGDFRSYGAADHYGPDPTKARPASSFAHIPNYSNFSSQAINPGFLDSGTIRGVSGIGVTLFIALYDYEARTEDDLTFTKGEKFHILNNTEGDWWEARSLSSGKTGCIPSNYVAPVDSIQAEEWYFGKIGRKDAERQLLSPGNPQGAFLIRESETTKGAYSLSIRDWDQTRGDHVKHYKIRKLDMGGYYITTRVQFNSVQELVQHYMEVNDGLCNLLIAPCTIMKPQTLGLAKDAWEISRSSITLERRLGTGCFGDVWLGTWNGSTKVAVKTLKPGTMSPKAFLEEAQVMKLLRHDKLVQLYAVVSEEPIYIVTEFMCHGSLLDFLKNPEGQDLRLPQLVDMAAQVAEGMAYMERMNYIHRDLRAANILVGERLACKIADFGLARLIKDDEYNPCQGSKFPIKWTAPEAALFGRFTIKSDVWSFGILLTELITKGRIPYPGMNKREVLEQVEQGYHMPCPPGCPASLYEAMEQTWRLDPEERPTFEYLQSFLEDYFTSAEPQYQPGDQT

SEQ ID NO: 31751 - protein, 529 aa, Homo sapiens; identical to SEQ ID NO: 31750
  Payload ID: 6212
  Gene Symbol: FGR
  Gene Name: FGR proto-oncogene, Src family tyrosine kinase
  Uniprot ID: P09769
  ENSP ID: ENSP00000363116

SEQ ID NO: 31752 - protein, 529 aa, Homo sapiens; identical to SEQ ID NO: 31750
  Payload ID: 6212
  Gene Symbol: FGR
  Gene Name: FGR proto-oncogene, Src family tyrosine kinase
  Uniprot ID: P09769
  ENSP ID: ENSP00000363117

SEQ ID NO: 31753 - protein, 529 aa, Homo sapiens; identical to SEQ ID NO: 31750
  Payload ID: 6212
  Gene Symbol: FGR
  Gene Name: FGR proto-oncogene, Src family tyrosine kinase
  Uniprot ID: P09769
  ENSP ID: ENSP00000382126

SEQ ID NO: 31754 - protein, 312 aa, Homo sapiens
  Payload ID: 6212
  Gene Symbol: FGR
  Gene Name: FGR proto-oncogene, Src family tyrosine kinase
  ENSP ID: ENSP00000407670
MGCVFCKKLEPVATAKEDAGLEGDFRSYGAADHYGPDPTKARPASSFAHIPNYSNFSSQAINPGFLDSGTIRGVSGIGVTLFIALYDYEARTEDDLTFTKGEKFHILNNTEGDWWEARSLSSGKTGCIPSNYVAPVDSIQAEEWYFGKIGRKDAERQLLSPGNPQGAFLIRESETTKGAYSLSIRDWDQTRGDHVKHYKIRKLDMGGYYITTRVQFNSVQELVQHYMEVNDGLCNLLIAPCTIMKPQTLGLAKDAWEISRSSITLERRLGTGCFGDVWLGTWNGSTKVAVKTLKPGTMSPKAFLEEAQVMKL

SEQ ID NO: 31755 - protein, 1143 aa, Homo sapiens
  Payload ID: 6213
  Gene Symbol: FHDC1
  Gene Name: FH2 domain containing 1
  Uniprot ID: Q9C0D6
  ENSP ID: ENSP00000260008
MHVMNCVSLVSDKENGNIATAPGFMIGQTPPPAPPPPPPPPPPSPPCSCSREECPSSPPPPPPPPLPGEPPIPPPPPGLPPTTHMNGYSHLGKKKRMRSFFWKTIPEEQVRGKTNIWTLAARQEHHYQIDTKTIEELFGQQEDTTKSSLPRRGRTLNSSFREAREEITILDAKRSMNIGIFLKQFKKSPRSIVEDIHQGKSEHYGSETLREFLKFLPESEEVKKLKAFSGDVSKLSLADSFLYGLIQVPNYSLRIEAMVLKKEFLPSCSSLYTDITVLRTAIKELMSCEELHSILHLVLQAGNIMNAGGYAGNAVGFKLSSLLKLADTKANKPGMNLLHFVAQEAQKKDTILLNFSEKLHHVQKTARLSLENTEAELHLLFVRTKSLKENIQRDGELCQQMEDFLQFAIEKLRELECWKQELQDEAYTLIDFFCEDKKTMKLDECFQIFRDFCTKFNKAVKDNHDREAQELRQLQRLKEQEQKQRSWATGELGAFGRSSSENDVELLTKKGAEGLLPFLHPRPISPSSPSYRPPNTRRSRLSLGPSADRELLTFLESSTGSPEEPNKFHSLPRSSPRQARPTIACLEPAEVRHQDSSFAHKPQASGGQEEAPNPPSAQAHQLAAAQPENHASAFPRARRQGVSVLRKRYSEPVSLGSAQSPPLSPLALGIKEHELVTGLAQFNLQGSQGMEETSQLTLSDFSPMELESVGHRGPQSLSASSSSLTPMGRDALGSLSPALEDGKAAPDEPGSAALGSVGSSDPENKDPRPLFCISDTTDCSLTLDCSEGTDSRPRGGDPEEGGEGDGSMSSGVGEMGDSQVSSNPTSSPPGEAPAPVSVDSEPSCKGGLPRDKPTKRKDVVAPKRGSLKEASPGASKPGSARRSQGAVAKSVRTLTASENESMRKVMPITKSSRGAGWRRPELSSRGPSQNPPSSTDTVWSRQNSVRRASTGAEEQRLPRGSSGSSSTRPGRDVPLQPRGSFKKPSAKPLRNLPRQKPEENKTCRAHSEGPESPKEEPKTPSVPSVPHELPRVPSFARNTVASSSRSMRTDLPPVAKAPGITRTVSQRQLRVKGDPEDAAPKDSSTLRRASSARAPKKRPESAEGPSANTEAPLKARGAGERASLRRKDSSRTTLGRILNPLRK

SEQ ID NO: 31756 - protein, 1143 aa, Homo sapiens; identical to SEQ ID NO: 31755
  Payload ID: 6213
  Gene Symbol: FHDC1
  Gene Name: FH2 domain containing 1
  Uniprot ID: Q9C0D6
  ENSP ID: ENSP00000427567

SEQ ID NO: 31757 - protein, 321 aa, Homo sapiens
  Payload ID: 6214
  Gene Symbol: FBL
  Gene Name: fibrillarin
  Uniprot ID: P22087
  ENSP ID: ENSP00000221801
MKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDQTRIVALNAHTFLRNGGHFVISIKANCIDSTASAEAVFASEVKKMQQENMKPQEQLTLEPYERDHAVVVGVYRPPPKVKN

SEQ ID NO: 31758 - protein, 40 aa, Homo sapiens
  Payload ID: 6214
  Gene Symbol: FBL
  Gene Name: fibrillarin
  ENSP ID: ENSP00000469072
MKPGGGFHSGGNRGRGRGGKRGNQSGKNVMVEPHRHEGRR

SEQ ID NO: 31759 - protein, 244 aa, Homo sapiens
  Payload ID: 6214
  Gene Symbol: FBL
  Gene Name: fibrillarin
  ENSP ID: ENSP00000469249
GRGGFGGGRGRGGGFRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDQTRIVALNAHTFLRNGGHFVISIKANCIDSTASAEAVFASEVKKMQQENMKPQEQLTLEPYERDH

SEQ ID NO: 31760 - protein, 228 aa, Homo sapiens
  Payload ID: 6214
  Gene Symbol: FBL
  Gene Name: fibrillarin
  ENSP ID: ENSP00000471350
MKPGFSPRGGGFGGRGGFGDRGGRGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDQTRIVALNAHTFLRNGGHFVISIK

SEQ ID NO: 31761 - protein, 178 aa, Homo sapiens
  Payload ID: 6214
  Gene Symbol: FBL
  Gene Name: fibrillarin
  ENSP ID: ENSP00000471867
MKPGFSPRGGGFGGRGGFGDRGGRGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVE

SEQ ID NO: 31762 - protein, 229 aa, Homo sapiens
  Payload ID: 6214
  Gene Symbol: FBL
  Gene Name: fibrillarin
  ENSP ID: ENSP00000472419
VMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDQTRIVALNAHTFLRNGGHFVISIKANCIDSTASAEAVFASEVKKMQQENMKPQEQLTLEPYERDHAVVVGVYR

SEQ ID NO: 31763 - protein, 182 aa, Homo sapiens
  Payload ID: 6214
  Gene Symbol: FBL
  Gene Name: fibrillarin
  ENSP ID: ENSP00000472433
MKPGFSPRGGGFGGRGGFGDRGGRGGRGGFGGGRGRGGGFRGRGRGGGGGGGGGGGGGRGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGP

SEQ ID NO: 31764 - protein, 273 aa, Homo sapiens
  Payload ID: 6214
  Gene Symbol: FBL
  Gene Name: fibrillarin
  ENSP ID: ENSP00000472726
MKPGFSPRGGGFGGRGGFGDRGGRGGRGGFGGGRGRGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDQTRIVALNAHTFLRNGGHFVISIKANCIDSTASAEAVFASEVKKMQQENMKPQEQL

SEQ ID NO: 31765 - protein, 157 aa, Homo sapiens
  Payload ID: 6214
  Gene Symbol: FBL
  Gene Name: fibrillarin
  ENSP ID: ENSP00000472805
MKPGFSPRGGGFGGRGGFGDRGGRGGRGGFGGGRGRGGGFRGRGRGGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAAS

SEQ ID NO: 31766 - protein, 244 aa, Homo sapiens; identical to SEQ ID NO: 31759
  Payload ID: 6214
  Gene Symbol: FBL
  Gene Name: fibrillarin
  ENSP ID: ENSP00000485785

SEQ ID NO: 31767 - protein, 157 aa, Homo sapiens; identical to SEQ ID NO: 31765
  Payload ID: 6214
  Gene Symbol: FBL
  Gene Name: fibrillarin
  ENSP ID: ENSP00000485834

SEQ ID NO: 31768 - protein, 182 aa, Homo sapiens; identical to SEQ ID NO: 31763
  Payload ID: 6214
  Gene Symbol: FBL
  Gene Name: fibrillarin
  ENSP ID: ENSP00000485963

SEQ ID NO: 31769 - protein, 229 aa, Homo sapiens; identical to SEQ ID NO: 31762
  Payload ID: 6214
  Gene Symbol: FBL
  Gene Name: fibrillarin
  ENSP ID: ENSP00000486271

SEQ ID NO: 31770 - protein, 37 aa, Homo sapiens
  Payload ID: 6214
  Gene Symbol: FBL
  Gene Name: fibrillarin
  ENSP ID: ENSP00000486564
GGGFHSGGNRGRGRGGKRGNQSGKNVMVEPHRHEGDR

SEQ ID NO: 31771 - protein, 37 aa, Homo sapiens; identical to SEQ ID NO: 31770
  Payload ID: 6214
  Gene Symbol: FBL
  Gene Name: fibrillarin
  ENSP ID: ENSP00000486736

SEQ ID NO: 31772 - protein, 178 aa, Homo sapiens; identical to SEQ ID NO: 31761
  Payload ID: 6214
  Gene Symbol: FBL
  Gene Name: fibrillarin
  ENSP ID: ENSP00000486882

SEQ ID NO: 31773 - protein, 228 aa, Homo sapiens; identical to SEQ ID NO: 31760
  Payload ID: 6214
  Gene Symbol: FBL
  Gene Name: fibrillarin
  ENSP ID: ENSP00000487026

SEQ ID NO: 31774 - protein, 40 aa, Homo sapiens; identical to SEQ ID NO: 31758
  Payload ID: 6214
  Gene Symbol: FBL
  Gene Name: fibrillarin
  ENSP ID: ENSP00000487091

SEQ ID NO: 31775 - protein, 273 aa, Homo sapiens; identical to SEQ ID NO: 31764
  Payload ID: 6214
  Gene Symbol: FBL
  Gene Name: fibrillarin
  ENSP ID: ENSP00000487170

SEQ ID NO: 31776 - protein, 321 aa, Homo sapiens; identical to SEQ ID NO: 31757
  Payload ID: 6214
  Gene Symbol: FBL
  Gene Name: fibrillarin
  Uniprot ID: P22087
  ENSP ID: ENSP00000487390

SEQ ID NO: 31777 - protein, 334 aa, Homo sapiens
  Payload ID: 6215
  Gene Symbol: FBLL1
  Gene Name: fibrillarin-like 1
  Uniprot ID: A6NHQ2
  ENSP ID: ENSP00000473383
MKSAASSRGGGGGGRGGGGWGSWGGGRGGGGGAGKGGGGDGGGQGGKGGFGARARGFGGGGRGRGRGGGDGKDRGGGGQRRGGVAKSKSRRRKGAMVVSVEPHRHEGVFIYRGAEDALVTLNMVPGQSVYGERRVTVTEGGVKQEYRTWNPFRSKLAAAILGGVDQIHIKPKSKVLYLGAASGTTVSHVSDIIGPDGLVYAVEFSHRAGRDLVNVAKKRTNIIPVLEDARHPLKYRMLIGMVDVIFADVAQPDQSRIVALNAHTFLRNGGHFLISIKANCIDSTASAEAVFASEVRKLQQENLKPQEQLTLEPYERDHAVVVGVYRPLPKSSSK

SEQ ID NO: 31778 - protein, 2871 aa, Homo sapiens
  Payload ID: 6216
  Gene Symbol: FBN1
  Gene Name: fibrillin 1
  Uniprot ID: P35555
  ENSP ID: ENSP00000325527
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSYRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 31779 - protein, 302 aa, Homo sapiens
  Payload ID: 6216
  Gene Symbol: FBN1
  Gene Name: fibrillin 1
  ENSP ID: ENSP00000440294
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATTSMNVKLEHTTVANMLYVPIQQEASNVAAVPGGLEMALSALIWTNVPMEPICAASMQTARIPWDLTAVCARKDTQVMASLVQTLMSALRT

SEQ ID NO: 31780 - protein, 55 aa, Homo sapiens
  Payload ID: 6216
  Gene Symbol: FBN1
  Gene Name: fibrillin 1
  ENSP ID: ENSP00000453901
MRRGRLLEIALGFTVLLASYTSHGADANLEAGNVKETRASRAKRRGGGGHDALKG

SEQ ID NO: 31781 - protein, 853 aa, Homo sapiens
  Payload ID: 6216
  Gene Symbol: FBN1
  Gene Name: fibrillin 1
  ENSP ID: ENSP00000453958
  MOD_RES (1)..(1): Any amino acid
XLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDVILSLLLLSPAFPSCFFSPRTIGKGTASQRCYKTCVRSAPATGTPSPNRNAAVTEGEAGVPTVRSALSRGLWLSRNSVPMAEDS

SEQ ID NO: 31782 - protein, 2912 aa, Homo sapiens
  Payload ID: 6217
  Gene Symbol: FBN2
  Gene Name: fibrillin 2
  Uniprot ID: P35556
  ENSP ID: ENSP00000262464
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 31783 - protein, 2912 aa, Homo sapiens; identical to SEQ ID NO: 31782
  Payload ID: 6217
  Gene Symbol: FBN2
  Gene Name: fibrillin 2
  Uniprot ID: P35556
  ENSP ID: ENSP00000424571

SEQ ID NO: 31784 - protein, 341 aa, Homo sapiens
  Payload ID: 6217
  Gene Symbol: FBN2
  Gene Name: fibrillin 2
  ENSP ID: ENSP00000424753
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEVHVDKAQAGARCPCVILPSRLYLR

SEQ ID NO: 31785 - protein, 1473 aa, Homo sapiens
  Payload ID: 6217
  Gene Symbol: FBN2
  Gene Name: fibrillin 2
  ENSP ID: ENSP00000425596
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVLQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQGGSPGFQLIFKLDQPQ

SEQ ID NO: 31786 - protein, 356 aa, Homo sapiens
  Payload ID: 6217
  Gene Symbol: FBN2
  Gene Name: fibrillin 2
  ENSP ID: ENSP00000426839
MMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQGGSPGFQLIFKLDQPQ

SEQ ID NO: 31787 - protein, 276 aa, Homo sapiens
  Payload ID: 6217
  Gene Symbol: FBN2
  Gene Name: fibrillin 2
  ENSP ID: ENSP00000479157
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPHPHWSLPRC

SEQ ID NO: 31788 - protein, 2911 aa, Homo sapiens
  Payload ID: 6217
  Gene Symbol: FBN2
  Gene Name: fibrillin 2
  ENSP ID: ENSP00000482132
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCITQPCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 31789 - protein, 2809 aa, Homo sapiens
  Payload ID: 6218
  Gene Symbol: FBN3
  Gene Name: fibrillin 3
  Uniprot ID: Q75N90
  ENSP ID: ENSP00000270509
MTLEGLYLARGPLARLLLAWSALLCMAGGQGRWDGALEAAGPGRVRRRGSPGILQGPNVCGSRFHAYCCPGWRTFPGRSQCVVPICRRACGEGFCSQPNLCTCADGTLAPSCGVSRGSGCSVSCMNGGTCRGASCLCQKGYTGTVCGQPICDRGCHNGGRCIGPNRCACVYGFMGPQCERDYRTGPCFGQVGPEGCQHQLTGLVCTKALCCATVGRAWGLPCELCPAQPHPCRRGFIPNIHTGACQDVDECQAVPGLCQGGSCVNMVGSFHCRCPVGHRLSDSSAACEDYRAGACFSVLFGGRCAGDLAGHYTRRQCCCDRGRCWAAGPVPELCPPRGSNEFQQLCAQRLPLLPGHPGLFPGLLGFGSNGMGPPLGPARLNPHGSDARGIPSLGPGNSNIGTATLNQTIDICRHFTNLCLNGRCLPTPSSYRCECNVGYTQDVRGECIDVDECTSSPCHHGDCVNIPGTYHCRCYPGFQATPTRQACVDVDECIVSGGLCHLGRCVNTEGSFQCVCNAGFELSPDGKNCVDHNECATSTMCVNGVCLNEDGSFSCLCKPGFLLAPGGHYCMDIDECQTPGICVNGHCTNTEGSFRCQCLGGLAVGTDGRVCVDTHVRSTCYGAIEKGSCARPFPGTVTKSECCCANPDHGFGEPCQLCPAKDSAEFQALCSSGLGITTDGRDINECALDPEVCANGVCENLRGSYRCVCNLGYEAGASGKDCTDVDECALNSLLCDNGWCQNSPGSYSCSCPPGFHFWQDTEICKDVDECLSSPCVSGVCRNLAGSYTCKCGPGSRLDPSGTFCLDSTKGTCWLKIQESRCEVNLQGASLRSECCATLGAAWGSPCERCEIDPACARGFARMTGVTCDDVNECESFPGVCPNGRCVNTAGSFRCECPEGLMLDASGRLCVDVRLEPCFLRWDEDECGVTLPGKYRMDVCCCSIGAVWGVECEACPDPESLEFASLCPRGLGFASRDFLSGRPFYKDVNECKVFPGLCTHGTCRNTVGSFHCACAGGFALDAQERNCTDIDECRISPDLCGQGTCVNTPGSFECECFPGYESGFMLMKNCMDVDECARDPLLCRGGTCTNTDGSYKCQCPPGHELTAKGTACEDIDECSLSDGLCPHGQCVNVIGAFQCSCHAGFQSTPDRQGCVDINECRVQNGGCDVHCINTEGSYRCSCGQGYSLMPDGRACADVDECEENPRVCDQGHCTNMPGGHRCLCYDGFMATPDMRTCVDVDECDLNPHICLHGDCENTKGSFVCHCQLGYMVRKGATGCSDVDECEVGGHNCDSHASCLNIPGSFSCRCLPGWVGDGFECHDLDECVSQEHRCSPRGDCLNVPGSYRCTCRQGFAGDGFFCEDRDECAENVDLCDNGQCLNAPGGYRCECEMGFDPTEDHRACQDVDECAQGNLCAFGSCENLPGMFRCICNGGYELDRGGGNCTDINECADPVNCINGVCINTPGSYLCSCPQDFELNPSGVGCVDTRAGNCFLETHDRGDSGISCSAEIGVGVTRASCCCSLGRAWGNPCELCPMANTTEYRTLCPGGEGFQPNRITVILEDIDECQELPGLCQGGDCVNTFGSFQCECPPGYHLSEHTRICEDIDECSTHSGICGPGTCYNTLGNYTCVCPAEYLQVNGGNNCMDMRKSVCFRHYNGTCQNELAFNVTRKMCCCSYNIGQAWNRPCEACPTPISPDYQILCGNQAPGFLTDIHTGKPLDIDECGEIPAICANGICINQIGSFRCECPAGFNYNSILLACEDVDECGSRESPCQQNADCINIPGSYRCKCTRGYKLSPGGACVGRNECREIPNVCSHGDCMDTEGSYMCLCHRGFQASADQTLCMDIDECDRQPCGNGTCKNIIGSYNCLCFPGFVVTHNGDCVDFDECTTLVGQVCRFGHCLNTAGSFHCLCQDGFELTADGKNCVDTNECLSLAGTCLPGTCQNLEGSFRCICPPGFQVQSDHCIDIDECSEEPNLCLFGTCTNSPGSFQCLCPPGFVLSDNGHRCFDTRQSFCFTRFEAGKCSVPKAFNTTKTRCCCSKRPGEGWGDPCELCPQEGSAAFQELCPFGHGAVPGPDDSREDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVDECADGQQDCHARGMECKNLIGTFACVCPPGMRPLPGSGEGCTDDNECHAQPDLCVNGRCVNTAGSFRCDCDEGFQPSPTLTECHDIRQGPCFAEVLQTMCRSLSSSSEAVTRAECCCGGGRGWGPRCELCPLPGTSAYRKLCPHGSGYTAEGRDVDECRMLAHLCAHGECINSLGSFRCHCQAGYTPDATATTCLDMDECSQVPKPCTFLCKNTKGSFLCSCPRGYLLEEDGRTCKDLDECTSRQHNCQFLCVNTVGAFTCRCPPGFTQHHQACFDNDECSAQPGPCGAHGHCHNTPGSFRCECHQGFTLVSSGHGCEDVNECDGPHRCQHGCQNQLGGYRCSCPQGFTQHSQWAQCVDENECALSPPTCGSASCRNTLGGFRCVCPSGFDFDQALGGCQEVDECAGRRGPCSYSCANTPGGFLCGCPQGYFRAGQGHCVSGLGFSPGPQDTPDKEELLSSEACYECKINGLSPRDRPRRSAHRDHQVNLATLDSEALLTLGLNLSHLGRAERILELRPALEGLEGRIRYVIVRGNEQGFFRMHHLRGVSSLQLGRRRPGPGTYRLEVVSHMAGPWGVQPEGQPGPWGQALRLKVQLQLL

SEQ ID NO: 31790 - protein, 188 aa, Homo sapiens
  Payload ID: 6218
  Gene Symbol: FBN3
  Gene Name: fibrillin 3
  ENSP ID: ENSP00000469256
  MOD_RES (1)..(1): Any amino acid
XYQILCGNQAPGFLTDIHTGKPLDVDECGSRESPCQQNADCINIPGSYRCKCTRGYKLSPGGACVGRNECREIPNVCSHGDCMDTEGSYMCLCHRGFQASADQTLCMDIDECDRQPCGNGTCKNIIGSYNCLCFPGFVVTHNGDCVDFDECTTLVGQVCRFGHCLNTAGSFHCLCQDGFELTADGKNC

SEQ ID NO: 31791 - protein, 2809 aa, Homo sapiens; identical to SEQ ID NO: 31789
  Payload ID: 6218
  Gene Symbol: FBN3
  Gene Name: fibrillin 3
  Uniprot ID: Q75N90
  ENSP ID: ENSP00000470498

SEQ ID NO: 31792 - protein, 2809 aa, Homo sapiens; identical to SEQ ID NO: 31789
  Payload ID: 6218
  Gene Symbol: FBN3
  Gene Name: fibrillin 3
  Uniprot ID: Q75N90
  ENSP ID: ENSP00000472324

SEQ ID NO: 31793 - protein, 171 aa, Homo sapiens
  Payload ID: 6218
  Gene Symbol: FBN3
  Gene Name: fibrillin 3
  ENSP ID: ENSP00000472729
  MOD_RES (1)..(1): Any amino acid
XFTRFEAGKCSVPKAFNTTKTRCCCSKRPGEGWGDPCELCPQEGSDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVD

SEQ ID NO: 31794 - protein, 866 aa, Homo sapiens
  Payload ID: 6219
  Gene Symbol: FGA
  Gene Name: fibrinogen alpha chain
  Uniprot ID: P02671
  ENSP ID: ENSP00000306361
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENCAEVYGGGWWYNNCQAANLNGIYYPGGSYDPRNNSPYEIENGVVWVSFRGADYSLRAVRMKIRPLVTQ

SEQ ID NO: 31795 - protein, 644 aa, Homo sapiens
  Payload ID: 6219
  Gene Symbol: FGA
  Gene Name: fibrinogen alpha chain
  Uniprot ID: P02671
  ENSP ID: ENSP00000385981
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRGIHTSPLGKPSLSP

SEQ ID NO: 31796 - protein, 289 aa, Homo sapiens [sequence omitted]

SEQ ID NO: 31797 - protein, 491 aa, Homo sapiens
  Payload ID: 6220
  Gene Symbol: FGB
  Gene Name: fibrinogen beta chain
  Uniprot ID: P02675
  ENSP ID: ENSP00000306099
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 31798 - protein, 45 aa, Homo sapiens
  Payload ID: 6220
  Gene Symbol: FGB
  Gene Name: fibrinogen beta chain
  ENSP ID: ENSP00000398719
MKRMVSWSFHKLKTMKHLLLLLLCVFLVKSQGVNDNEEMRKLGHR

SEQ ID NO: 31799 - protein, 272 aa, Homo sapiens
  Payload ID: 6220
  Gene Symbol: FGB
  Gene Name: fibrinogen beta chain
  ENSP ID: ENSP00000426757
MEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 31800 - protein, 303 aa, Homo sapiens
  Payload ID: 6221
  Gene Symbol: FIBCD1
  Gene Name: fibrinogen C domain containing 1
  ENSP ID: ENSP00000361412
MGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGLKRIHALTTQAAYELHVDLEDFENGTAYARYGSFGVGLFSVDPEEDGYPLTVADYSGTAGDSLLKHSGMRFTTKDRDSDHSENNCAAFYRGAWWYRNCHTSNLNGQYLRGAHASYADGVEWSSWTGWQYSLKFSEMKIRPVREDR

SEQ ID NO: 31801 - protein, 461 aa, Homo sapiens
  Payload ID: 6221
  Gene Symbol: FIBCD1
  Gene Name: fibrinogen C domain containing 1
  Uniprot ID: Q8N539
  ENSP ID: ENSP00000361413
MVNDRWKTMGGAAQLEDRPRDKPQRPSCGYVLCTVLLALAVLLAVAVTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGLKRIHALTTQAAYELHVDLEDFENGTAYARYGSFGVGLFSVDPEEDGYPLTVADYSGTAGDSLLKHSGMRFTTKDRDSDHSENNCAAFYRGAWWYRNCHTSNLNGQYLRGAHASYADGVEWSSWTGWQYSLKFSEMKIRPVREDR

SEQ ID NO: 31802 - protein, 289 aa, Homo sapiens
  Payload ID: 6221
  Gene Symbol: FIBCD1
  Gene Name: fibrinogen C domain containing 1
  ENSP ID: ENSP00000393894
MVNDRWKTMGGAAQLEDRPRDKPQRPSCGYVLCTVLLALAVLLAVAVTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRRE

SEQ ID NO: 31803 - protein, 310 aa, Homo sapiens
  Payload ID: 6221
  Gene Symbol: FIBCD1
  Gene Name: fibrinogen C domain containing 1
  ENSP ID: ENSP00000395319
  MOD_RES (1)..(1): Any amino acid
XTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGPLDWCTLSLALLVPVAPSPTPPHSFVNVLHPPVPGGPTLQ

SEQ ID NO: 31804 - protein, 461 aa, Homo sapiens; identical to SEQ ID NO: 31801
  Payload ID: 6221
  Gene Symbol: FIBCD1
  Gene Name: fibrinogen C domain containing 1
  Uniprot ID: Q8N539
  ENSP ID: ENSP00000414501

SEQ ID NO: 31805 - protein, 453 aa, Homo sapiens
  Payload ID: 6222
  Gene Symbol: FGG
  Gene Name: fibrinogen gamma chain
  Uniprot ID: P02679
  ENSP ID: ENSP00000336829
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 31806 - protein, 119 aa, Homo sapiens
  Payload ID: 6222
  Gene Symbol: FGG
  Gene Name: fibrinogen gamma chain
  ENSP ID: ENSP00000377429
MIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQK

SEQ ID NO: 31807 - protein, 445 aa, Homo sapiens
  Payload ID: 6222
  Gene Symbol: FGG
  Gene Name: fibrinogen gamma chain
  ENSP ID: ENSP00000384101
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKVKVDSPSLDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 31808 - protein, 461 aa, Homo sapiens
  Payload ID: 6222
  Gene Symbol: FGG
  Gene Name: fibrinogen gamma chain
  ENSP ID: ENSP00000384552
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKVKVDSPSLDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 31809 - protein, 437 aa, Homo sapiens
  Payload ID: 6222
  Gene Symbol: FGG
  Gene Name: fibrinogen gamma chain
  Uniprot ID: P02679
  ENSP ID: ENSP00000384860
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 31810 - protein, 123 aa, Homo sapiens
  Payload ID: 6222
  Gene Symbol: FGG
  Gene Name: fibrinogen gamma chain
  ENSP ID: ENSP00000407562
MIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDG

SEQ ID NO: 31811 - protein, 299 aa, Homo sapiens
  Payload ID: 6223
  Gene Symbol: FSBP
  Gene Name: fibrinogen silencer binding protein
  Uniprot ID: O95073
  ENSP ID: ENSP00000420405
MVGKARSSNFTLSEKLDLLKLVKPYVKILEEHTNKHSVIVEKNRCWDIIAVNYNAIGVDRPPRTAQGLRTLYKRLKEYAKQELLQQKETQSDFKSNISEPTKKVMEMIPQISSFCLVRDRNHIQSANLDEEAQAGTSSLQVMLDHHPVAITVEVKQEEDIKPPPPLVLNSQQSDTLEQREEHELVHVMERSLSPSLSSVDMRMTSSPSSIPRRDDFFRHESGEHFRSLLGYDPQILQMLKEEHQIILENQKNFGLYVQEKRDGLKRRQQLEEELLRAKIEVEKLKAIRLRHDLPEYNSL

SEQ ID NO: 31812 - protein, 129 aa, Homo sapiens
  Payload ID: 6223
  Gene Symbol: FSBP
  Gene Name: fibrinogen silencer binding protein
  ENSP ID: ENSP00000462684
MVGKARSSNFTLSEKLDLLKLVKPYVKILEEHTNKHSVIVEKNRCWDIIAVNYNAIGVDRPPRTAQGLRTLYKRLKEYAKQELLQQKETQSDFKSNISEPTKKVMEMIPQISSFCLVRDRNHIQSSFGS

SEQ ID NO: 31813 - protein, 312 aa, Homo sapiens
  Payload ID: 6224
  Gene Symbol: FGL1
  Gene Name: fibrinogen-like 1
  Uniprot ID: Q08830
  ENSP ID: ENSP00000371262
MAKVFSFILVTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 31814 - protein, 312 aa, Homo sapiens; identical to SEQ ID NO: 31813
  Payload ID: 6224
  Gene Symbol: FGL1
  Gene Name: fibrinogen-like 1
  Uniprot ID: Q08830
  ENSP ID: ENSP00000371263

SEQ ID NO: 31815 - protein, 312 aa, Homo sapiens; identical to SEQ ID NO: 31813
  Payload ID: 6224
  Gene Symbol: FGL1
  Gene Name: fibrinogen-like 1
  Uniprot ID: Q08830
  ENSP ID: ENSP00000381131

SEQ ID NO: 31816 - protein, 312 aa, Homo sapiens; identical to SEQ ID NO: 31813
  Payload ID: 6224
  Gene Symbol: FGL1
  Gene Name: fibrinogen-like 1
  Uniprot ID: Q08830
  ENSP ID: ENSP00000381133

SEQ ID NO: 31817 - protein, 312 aa, Homo sapiens; identical to SEQ ID NO: 31813
  Payload ID: 6224
  Gene Symbol: FGL1
  Gene Name: fibrinogen-like 1
  Uniprot ID: Q08830
  ENSP ID: ENSP00000401952

SEQ ID NO: 31818 - protein, 312 aa, Homo sapiens; identical to SEQ ID NO: 31813
  Payload ID: 6224
  Gene Symbol: FGL1
  Gene Name: fibrinogen-like 1
  Uniprot ID: Q08830
  ENSP ID: ENSP00000428430

SEQ ID NO: 31819 - protein, 312 aa, Homo sapiens; identical to SEQ ID NO: 31813
  Payload ID: 6224
  Gene Symbol: FGL1
  Gene Name: fibrinogen-like 1
  Uniprot ID: Q08830
  ENSP ID: ENSP00000429757

SEQ ID NO: 31820 - protein, 439 aa, Homo sapiens
  Payload ID: 6225
  Gene Symbol: FGL2
  Gene Name: fibrinogen-like 2
  Uniprot ID: Q14314
  ENSP ID: ENSP00000248598
MKLANWYWLSSAVLATYGFLVVANNETEEIKDERAKDVCPVRLESRGKCEEAGECPYQVSLPPLTIQLPKQFSRIEEVFKEVQNLKEIVNSLKKSCQDCKLQADDNGDPGRNGLLLPSTGAPGEVGDNRVRELESEVNKLSSELKNAKEEINVLHGRLEKLNLVNMNNIENYVDSKVANLTFVVNSLDGKCSKCPSQEQIQSRPVQHLIYKDCSDYYAIGKRSSETYRVTPDPKNSSFEVYCDMETMGGGWTVLQARLDGSTNFTRTWQDYKAGFGNLRREFWLGNDKIHLLTKSKEMILRIDLEDFNGVELYALYDQFYVANEFLKYRLHVGNYNGTAGDALRFNKHYNHDLKFFTTPDKDNDRYPSGNCGLYYSSGWWFDACLSANLNGKYYHQKYRGVRNGIFWGTWPGVSEAHPGGYKSSFKEAKMMIRPKHFKP

SEQ ID NO: 31821 - protein, 760 aa, Homo sapiens
  Payload ID: 6226
  Gene Symbol: FAP
  Gene Name: fibroblast activation protein, alpha
  Uniprot ID: Q12884
  ENSP ID: ENSP00000188790
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 31822 - protein, 155 aa, Homo sapiens
  Payload ID: 6226
  Gene Symbol: FAP
  Gene Name: fibroblast activation protein, alpha
  ENSP ID: ENSP00000400137
MCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRP

SEQ ID NO: 31823 - protein, 121 aa, Homo sapiens
  Payload ID: 6226
  Gene Symbol: FAP
  Gene Name: fibroblast activation protein, alpha
  ENSP ID: ENSP00000407404
MCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGKWQL

SEQ ID NO: 31824 - protein, 735 aa, Homo sapiens
  Payload ID: 6226
  Gene Symbol: FAP
  Gene Name: fibroblast activation protein, alpha
  ENSP ID: ENSP00000411391
MKTWVKIVFGVATSAVLALLVMCIVLRPSRVHNSEENTMRALTLKDILNGTFSYKTFFPNWISGQEYLHQSADNNIVLYNIETGQSYTILSNRTMLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 31825 - protein, 25 aa, Homo sapiens
  Payload ID: 6226
  Gene Symbol: FAP
  Gene Name: fibroblast activation protein, alpha
  ENSP ID: ENSP00000417028
KERCQYYTASFSDYAKYYALVCYGE

SEQ ID NO: 31826 - protein, 47 aa, Homo sapiens
  Payload ID: 6226
  Gene Symbol: FAP
  Gene Name: fibroblast activation protein, alpha
  ENSP ID: ENSP00000441940
  MOD_RES (1)..(1): Any amino acid
XYTERFMGLPTKDDNLEHYKNSTVMARAEYFRNVDYLLIHGTADGEV

SEQ ID NO: 31827 - protein, 759 aa, Homo sapiens
  Payload ID: 6226
  Gene Symbol: FAP
  Gene Name: fibroblast activation protein, alpha
  ENSP ID: ENSP00000485844
MTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 31828 - protein, 364 aa, Homo sapiens
  Payload ID: 6227
  Gene Symbol: FIBP
  Gene Name: fibroblast growth factor (acidic) intracellular binding protein
  Uniprot ID: O43427
  ENSP ID: ENSP00000344572
MTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVGEAPTDPDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 31829 - protein, 357 aa, Homo sapiens
  Payload ID: 6227
  Gene Symbol: FIBP
  Gene Name: fibroblast growth factor (acidic) intracellular binding protein
  Uniprot ID: O43427
  ENSP ID: ENSP00000350124
MTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 31830 - protein, 146 aa, Homo sapiens
  Payload ID: 6227
  Gene Symbol: FIBP
  Gene Name: fibroblast growth factor (acidic) intracellular binding protein
  ENSP ID: ENSP00000431414
MTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQGLCSHRLLC

SEQ ID NO: 31831 - protein, 137 aa, Homo sapiens
  Payload ID: 6227
  Gene Symbol: FIBP
  Gene Name: fibroblast growth factor (acidic) intracellular binding protein
  ENSP ID: ENSP00000431457
  MOD_RES (1)..(1): Any amino acid
XAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFR

SEQ ID NO: 31832 - protein, 146 aa, Homo sapiens; identical to SEQ ID NO: 31830
  Payload ID: 6227
  Gene Symbol: FIBP
  Gene Name: fibroblast growth factor (acidic) intracellular binding protein
  ENSP ID: ENSP00000433683

SEQ ID NO: 31833 - protein, 348 aa, Homo sapiens
  Payload ID: 6227
  Gene Symbol: FIBP
  Gene Name: fibroblast growth factor (acidic) intracellular binding protein
  ENSP ID: ENSP00000434043
MTSELDIFVGNTTLIDEDVYRLWLDVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKNLSRGLVNVAAKLTHNKDYSLGPAVCGTLPLRPLATQRRAVLPESVFSVCPLPRWLPTPGPLGPLHGHPPRLPPAPVS

SEQ ID NO: 31834 - protein, 155 aa, Homo sapiens
  Payload ID: 6228
  Gene Symbol: FGF1
  Gene Name: fibroblast growth factor 1 (acidic)
  Uniprot ID: P05230
  ENSP ID: ENSP00000338548
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 31835 - protein, 155 aa, Homo sapiens; identical to SEQ ID NO: 31834
  Payload ID: 6228
  Gene Symbol: FGF1
  Gene Name: fibroblast growth factor 1 (acidic)
  Uniprot ID: P05230
  ENSP ID: ENSP00000352329

SEQ ID NO: 31836 - protein, 60 aa, Homo sapiens
  Payload ID: 6228
  Gene Symbol: FGF1
  Gene Name: fibroblast growth factor 1 (acidic)
  Uniprot ID: P05230
  ENSP ID: ENSP00000354231
MAEGEITTFTALTEKFNLPPGNYKKPKLLYCSNGGHFLRILPDGTVDGTRDRSDQHTDTK

SEQ ID NO: 31837 - protein, 155 aa, Homo sapiens; identical to SEQ ID NO: 31834
  Payload ID: 6228
  Gene Symbol: FGF1
  Gene Name: fibroblast growth factor 1 (acidic)
  Uniprot ID: P05230
  ENSP ID: ENSP00000367285

SEQ ID NO: 31838 - protein, 58 aa, Homo sapiens
  Payload ID: 6228
  Gene Symbol: FGF1
  Gene Name: fibroblast growth factor 1 (acidic)
  ENSP ID: ENSP00000378005
MAEGEITTFTALTEKFNLPPGNYKKPKLLYCSNGGHFLRILPDGTVDGTRDRSDQHIQ

SEQ ID NO: 31839 - protein, 93 aa, Homo sapiens
  Payload ID: 6228
  Gene Symbol: FGF1
  Gene Name: fibroblast growth factor 1 (acidic)
  ENSP ID: ENSP00000383969
MAEGEITTFTALTEKFNLPPGNYKKPKLLYCSNGGHFLRILPDGTVDGTRDRSDQHTAAQCGKRGGGVYKEYRDWPVLGHGHRRAFIRLTDTK

SEQ ID NO: 31840 - protein, 155 aa, Homo sapiens; identical to SEQ ID NO: 31834
  Payload ID: 6228
  Gene Symbol: FGF1
  Gene Name: fibroblast growth factor 1 (acidic)
  Uniprot ID: P05230
  ENSP ID: ENSP00000396195

SEQ ID NO: 31841 - protein, 41 aa, Homo sapiens
  Payload ID: 6228
  Gene Symbol: FGF1
  Gene Name: fibroblast growth factor 1 (acidic)
  ENSP ID: ENSP00000399458
MAEGEITTFTALTEKFNLPPGNYKKPKLLYCSNGGHFLRIL

SEQ ID NO: 31842 - protein, 155 aa, Homo sapiens; identical to SEQ ID NO: 31834
  Payload ID: 6228
  Gene Symbol: FGF1
  Gene Name: fibroblast growth factor 1 (acidic)
  Uniprot ID: P05230
  ENSP ID: ENSP00000404742

SEQ ID NO: 31843 - protein, 155 aa, Homo sapiens; identical to SEQ ID NO: 31834
  Payload ID: 6228
  Gene Symbol: FGF1
  Gene Name: fibroblast growth factor 1 (acidic)
  Uniprot ID: P05230
  ENSP ID: ENSP00000479024

SEQ ID NO: 31844 - protein, 155 aa, Homo sapiens; identical to SEQ ID NO: 31834
  Payload ID: 6228
  Gene Symbol: FGF1
  Gene Name: fibroblast growth factor 1 (acidic)
  Uniprot ID: P05230
  ENSP ID: ENSP00000480791

SEQ ID NO: 31845 - protein, 155 aa, Homo sapiens; identical to SEQ ID NO: 31834
  Payload ID: 6228
  Gene Symbol: FGF1
  Gene Name: fibroblast growth factor 1 (acidic)
  Uniprot ID: P05230
  ENSP ID: ENSP00000480980

SEQ ID NO: 31846 - protein, 155 aa, Homo sapiens; identical to SEQ ID NO: 31834
  Payload ID: 6228
  Gene Symbol: FGF1
  Gene Name: fibroblast growth factor 1 (acidic)
  Uniprot ID: P05230
  ENSP ID: ENSP00000481868

SEQ ID NO: 31847 - protein, 208 aa, Homo sapiens
  Payload ID: 6229
  Gene Symbol: FGF10
  Gene Name: fibroblast growth factor 10
  Uniprot ID: O15520
  ENSP ID: ENSP00000264664
MWKWILTHCASAFPHLPGCCCCCFLLLFLVSSVPVTCQALGQDMVSPEATNSSSSSFSSPSSAGRHVRSYNHLQGDVRWRKLFSFTKYFLKIEKNGKVSGTKKENCPYSILEITSVEIGVVAVKAINSNYYLAMNKKGKLYGSKEFNNDCKLKERIEENGYNTYASFNWQHNGRQMYVALNGKGAPRRGQKTRRKNTSAHFLPMVVHS

SEQ ID NO: 31848 - protein, 66 aa, Homo sapiens
  Payload ID: 6229
  Gene Symbol: FGF10
  Gene Name: fibroblast growth factor 10
  ENSP ID: ENSP00000426406
MWKWILTHCASAFPHLPGCCCCCFLLLFLVSSVPVTCQALGQDMVSPEATNSSSSSFSSPSSAGRH

SEQ ID NO: 31849 - protein, 225 aa, Homo sapiens
  Payload ID: 6230
  Gene Symbol: FGF11
  Gene Name: fibroblast growth factor 11
  Uniprot ID: Q92914
  ENSP ID: ENSP00000293829
MAALASSLIRQKREVREPGGSRPVSAQRRVCPRGTKSLCQKQLLILLSKVRLCGGRPARPDRGPEPQLKGIVTKLFCRQGFYLQANPDGSIQGTPEDTSSFTHFNLIPVGLRVVTIQSAKLGHYMAMNAEGLLYSSPHFTAECRFKECVFENYYVLYASALYRQRRSGRAWYLGLDKEGQVMKGNRVKKTKAAAHFLPKLLEVAMYQEPSLHSVPEASPSSPPAP

SEQ ID NO: 31850 - protein, 101 aa, Homo sapiens
  Payload ID: 6230
  Gene Symbol: FGF11
  Gene Name: fibroblast growth factor 11
  ENSP ID: ENSP00000459746
MAMNAEGLLYSSPHFTAECRFKECVFENYYVLYASALYRQRRSGRAWYLGLDKEGQVMKGNRVKKTKAAAHFLPKLLEVAMYQEPSLHSVPEASPSSPPAP

SEQ ID NO: 31851 - protein, 101 aa, Homo sapiens; identical to SEQ ID NO: 31850
  Payload ID: 6230
  Gene Symbol: FGF11
  Gene Name: fibroblast growth factor 11
  ENSP ID: ENSP00000460753

SEQ ID NO: 31852 - protein, 101 aa, Homo sapiens; identical to SEQ ID NO: 31850
  Payload ID: 6230
  Gene Symbol: FGF11
  Gene Name: fibroblast growth factor 11
  ENSP ID: ENSP00000461397

SEQ ID NO: 31853 - protein, 101 aa, Homo sapiens; identical to SEQ ID NO: 31850
  Payload ID: 6230
  Gene Symbol: FGF11
  Gene Name: fibroblast growth factor 11
  ENSP ID: ENSP00000465134

SEQ ID NO: 31854 - protein, 181 aa, Homo sapiens
  Payload ID: 6231
  Gene Symbol: FGF12
  Gene Name: fibroblast growth factor 12
  Uniprot ID: P61328
  ENSP ID: ENSP00000393686
MESKEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 31855 - protein, 107 aa, Homo sapiens
  Payload ID: 6231
  Gene Symbol: FGF12
  Gene Name: fibroblast growth factor 12
  ENSP ID: ENSP00000395517
MESKEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQES

SEQ ID NO: 31856 - protein, 181 aa, Homo sapiens; identical to SEQ ID NO: 31854
  Payload ID: 6231
  Gene Symbol: FGF12
  Gene Name: fibroblast growth factor 12
  Uniprot ID: P61328
  ENSP ID: ENSP00000397635

SEQ ID NO: 31857 - protein, 144 aa, Homo sapiens
  Payload ID: 6231
  Gene Symbol: FGF12
  Gene Name: fibroblast growth factor 12
  ENSP ID: ENSP00000410125
MESKALFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 31858 - protein, 141 aa, Homo sapiens
  Payload ID: 6231
  Gene Symbol: FGF12
  Gene Name: fibroblast growth factor 12
  ENSP ID: ENSP00000412904
MHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSS

SEQ ID NO: 31859 - protein, 243 aa, Homo sapiens
  Payload ID: 6231
  Gene Symbol: FGF12
  Gene Name: fibroblast growth factor 12
  Uniprot ID: P61328
  ENSP ID: ENSP00000413496
MAAAIASSLIRQKRQARESNSDRVSASKRRSSPSKDGRSLCERHVLGVFSKVRFCSGRKRPVRRRPEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 31860 - protein, 192 aa, Homo sapiens
  Payload ID: 6232
  Gene Symbol: FGF13
  Gene Name: fibroblast growth factor 13
  Uniprot ID: Q92913
  ENSP ID: ENSP00000303391
MALLRKSYSEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 31861 - protein, 245 aa, Homo sapiens
  Payload ID: 6232
  Gene Symbol: FGF13
  Gene Name: fibroblast growth factor 13
  Uniprot ID: Q92913
  ENSP ID: ENSP00000322390
MAAAIASSLIRQKRQAREREKSNACKCVSSPSKGKTSCDKNKLNVFSRVKLFGSKKRRRRRPEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 31862 - protein, 43 aa, Homo sapiens
  Payload ID: 6232
  Gene Symbol: FGF13
  Gene Name: fibroblast growth factor 13
  ENSP ID: ENSP00000388688
MLRQDSIQSAELKKKESPFRAKCHEIFCCPLKQVHHKENTEPE

SEQ ID NO: 31863 - protein, 255 aa, Homo sapiens
  Payload ID: 6232
  Gene Symbol: FGF13
  Gene Name: fibroblast growth factor 13
  Uniprot ID: Q92913
  ENSP ID: ENSP00000396198
MSGKVTKPKEEKDASKVLDDAPPGTQEYIMLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 31864 - protein, 206 aa, Homo sapiens
  Payload ID: 6232
  Gene Symbol: FGF13
  Gene Name: fibroblast growth factor 13
  ENSP ID: ENSP00000406916
MRTSMKKVGMHHLSSSGGSYYLILDDAPPGTQEYIMLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKP

SEQ ID NO: 31865 - protein, 226 aa, Homo sapiens
  Payload ID: 6232
  Gene Symbol: FGF13
  Gene Name: fibroblast growth factor 13
  Uniprot ID: Q92913
  ENSP ID: ENSP00000409276
MLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 31866 - protein, 98 aa, Homo sapiens
  Payload ID: 6232
  Gene Symbol: FGF13
  Gene Name: fibroblast growth factor 13
  ENSP ID: ENSP00000411999
MSGKVTKPKEEKDASKVLDDAPPGTQEYIMLRQDSIQSAELKKKESPFRAKCHEIFCCPLKQVHHKENTEPEEPQLKGIVTKLYSRQGYHLQLQADGT

SEQ ID NO: 31867 - protein, 199 aa, Homo sapiens
  Payload ID: 6232
  Gene Symbol: FGF13
  Gene Name: fibroblast growth factor 13
  Uniprot ID: Q92913
  ENSP ID: ENSP00000487411
MSGKVTKPKEEKDASKEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 31868 - protein, 252 aa, Homo sapiens
  Payload ID: 6233
  Gene Symbol: FGF14
  Gene Name: fibroblast growth factor 14
  Uniprot ID: Q92915
  ENSP ID: ENSP00000365301
MVKPVPLFRRTDFKLLLCNHKDLFFLRVSKLLDCFSPKSMWFLWNIFSKGTHMLQCLCGKSLKKNKNPTDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 31869 - protein, 247 aa, Homo sapiens
  Payload ID: 6233
  Gene Symbol: FGF14
  Gene Name: fibroblast growth factor 14
  Uniprot ID: Q92915
  ENSP ID: ENSP00000365313
MAAAIASGLIRQKRQAREQHWDRPSASRRRSSPSKNRGLCNGNLVDIFSKVRIFGLKKRRLRRQDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 31870 - protein, 207 aa, Homo sapiens
  Payload ID: 6234
  Gene Symbol: FGF16
  Gene Name: fibroblast growth factor 16
  Uniprot ID: O43320
  ENSP ID: ENSP00000399324
MAEVGGVFASLDWDLHGFSSSLGNVPLADSPGFLNERLGQIEGKLQRGSPTDFAHLKGILRRRQLYCRTGFHLEIFPNGTVHGTRHDHSRFGILEFISLAVGLISIRGVDSGLYLGMNERGELYGSKKLTRECVFREQFEENWYNTYASTLYKHSDSERQYYVALNKDGSPREGYRTKRHQKFTHFLPRPVDPSKLPSMSRDLFHYR

SEQ ID NO: 31871 - protein, 216 aa, Homo sapiens
  Payload ID: 6235
  Gene Symbol: FGF17
  Gene Name: fibroblast growth factor 17
  Uniprot ID: O60258
  ENSP ID: ENSP00000352414
MGAARLLPNLTLCLQLLILCCQTQGENHPSPNFNQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 31872 - protein, 205 aa, Homo sapiens
  Payload ID: 6235
  Gene Symbol: FGF17
  Gene Name: fibroblast growth factor 17
  Uniprot ID: O60258
  ENSP ID: ENSP00000431041
MGAARLLPNLTLCLQLLILCCQTQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 31873 - protein, 207 aa, Homo sapiens
  Payload ID: 6236
  Gene Symbol: FGF18
  Gene Name: fibroblast growth factor 18
  Uniprot ID: O76093
  ENSP ID: ENSP00000274625
MYSAPSACTCLCLHFLLLCFQVQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 31874 - protein, 216 aa, Homo sapiens
  Payload ID: 6237
  Gene Symbol: FGF19
  Gene Name: fibroblast growth factor 19
  Uniprot ID: O95750
  ENSP ID: ENSP00000294312
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 31875 - protein, 288 aa, Homo sapiens
  Payload ID: 6238
  Gene Symbol: FGF2
  Gene Name: fibroblast growth factor 2 (basic)
  ENSP ID: ENSP00000264498
LVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 31876 - protein, 155 aa, Homo sapiens [sequence omitted]

SEQ ID NO: 31877 - protein, 288 aa, Homo sapiens; identical to SEQ ID NO: 31875
  Payload ID: 6238
  Gene Symbol: FGF2
  Gene Name: fibroblast growth factor 2 (basic)
  ENSP ID: ENSP00000478620

SEQ ID NO: 31878 - protein, 211 aa, Homo sapiens
  Payload ID: 6239
  Gene Symbol: FGF20
  Gene Name: fibroblast growth factor 20
  Uniprot ID: Q9NP95
  ENSP ID: ENSP00000180166
MAPLAEVGGFLGGLEGLGQQVGSHFLLPPAGERPPLLGERRSAAERSARGGPGAAQLAHLHGILRRRQLYCRTGFHLQILPDGSVQGTRQDHSLFGILEFISVAVGLVSIRGVDSGLYLGMNDKGELYGSEKLTSECIFREQFEENWYNTYSSNIYKHGDTGRRYFVALNKDGTPRDGARSKRHQKFTHFLPRPVDPERVPELYKDLLMYT

SEQ ID NO: 31879 - protein, 113 aa, Homo sapiens
  Payload ID: 6239
  Gene Symbol: FGF20
  Gene Name: fibroblast growth factor 20
  ENSP ID: ENSP00000428072
  MOD_RES (1)..(1): Any amino acid
XAAGSSIAAPASTCRSCPTAACRAPGRTTASSEKLTSECIFREQFEENWYNTYSSNIYKHGDTGRRYFVALNKDGTPRDGARSKRHQKFTHFLPRPVDPERVPELYKDLLMYT

SEQ ID NO: 31880 - protein, 209 aa, Homo sapiens
  Payload ID: 6240
  Gene Symbol: FGF21
  Gene Name: fibroblast growth factor 21
  Uniprot ID: Q9NSA1
  ENSP ID: ENSP00000222157
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 31881 - protein, 209 aa, Homo sapiens; identical to SEQ ID NO: 31880
  Payload ID: 6240
  Gene Symbol: FGF21
  Gene Name: fibroblast growth factor 21
  Uniprot ID: Q9NSA1
  ENSP ID: ENSP00000471477

SEQ ID NO: 31882 - protein, 170 aa, Homo sapiens
  Payload ID: 6241
  Gene Symbol: FGF22
  Gene Name: fibroblast growth factor 22
  Uniprot ID: Q9HCT0
  ENSP ID: ENSP00000215530
MRRRLWLGLAWLLLARAPDAAGTPSASRGPRSYPHLEGDVRWRRLFSSTHFFLRVDPGGRVQGTRWRHGQDSILEIRSVHVGVVVIKAVSSGFYVAMNRRGRLYGSRLYTVDCRFRERIEENGHNTYASQRWRRRGQPMFLALDRRGGPRPGGRTRRYHLSAHFLPVLVS

SEQ ID NO: 31883 - protein, 165 aa, Homo sapiens
  Payload ID: 6241
  Gene Symbol: FGF22
  Gene Name: fibroblast growth factor 22
  ENSP ID: ENSP00000466004
MRRRLWLGLAWLLLARAPDAAGTPSASRGPRSYPHLEGDVRWRRLFSSTHFFLRVDPGGRVQGTRWRHGQDSILEIRSVHVGVVVIKAVSSGFYVAMNRRGRLYGSVPGAHRRERPQHLRLTALAPPRPAHVPGAGQEGGAPARRPDAAVPPVRPLPARPGLLRP

SEQ ID NO: 31884 - protein, 251 aa, Homo sapiens
  Payload ID: 6242
  Gene Symbol: FGF23
  Gene Name: fibroblast growth factor 23
  Uniprot ID: Q9GZV9
  ENSP ID: ENSP00000237837
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 31885 - protein, 239 aa, Homo sapiens
  Payload ID: 6243
  Gene Symbol: FGF3
  Gene Name: fibroblast growth factor 3
  Uniprot ID: P11487
  ENSP ID: ENSP00000334122
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 31886 - protein, 206 aa, Homo sapiens
  Payload ID: 6244
  Gene Symbol: FGF4
  Gene Name: fibroblast growth factor 4
  Uniprot ID: P08620
  ENSP ID: ENSP00000168712
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 31887 - protein, 268 aa, Homo sapiens
  Payload ID: 6245
  Gene Symbol: FGF5
  Gene Name: fibroblast growth factor 5
  Uniprot ID: P12034
  ENSP ID: ENSP00000311697
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 31888 - protein, 123 aa, Homo sapiens
  Payload ID: 6245
  Gene Symbol: FGF5
  Gene Name: fibroblast growth factor 5
  Uniprot ID: P12034
  ENSP ID: ENSP00000398353
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSQVHR

SEQ ID NO: 31889 - protein, 119 aa, Homo sapiens
  Payload ID: 6245
  Gene Symbol: FGF5
  Gene Name: fibroblast growth factor 5
  ENSP ID: ENSP00000423903
NPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASNTLET

SEQ ID NO: 31890 - protein, 208 aa, Homo sapiens
  Payload ID: 6246
  Gene Symbol: FGF6
  Gene Name: fibroblast growth factor 6
  Uniprot ID: P10767
  ENSP ID: ENSP00000228837
MALGQKLFITMSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATPSFQEECKFRETLLPNNYNAYESDLYQGTYIALSKYGRVKRGSKVSPIMTVTHFLPRI

SEQ ID NO: 31891 - protein, 31 aa, Homo sapiens
  Payload ID: 6246
  Gene Symbol: FGF6
  Gene Name: fibroblast growth factor 6
  ENSP ID: ENSP00000445479
TVERGVVSLFGVRSALFVAMNSKGRLYATVK

SEQ ID NO: 31892 - protein, 194 aa, Homo sapiens
  Payload ID: 6247
  Gene Symbol: FGF7
  Gene Name: fibroblast growth factor 7
  Uniprot ID: P21781
  ENSP ID: ENSP00000267843
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 31893 - protein, 194 aa, Homo sapiens; identical to SEQ ID NO: 31892
  Payload ID: 6247
  Gene Symbol: FGF7
  Gene Name: fibroblast growth factor 7
  Uniprot ID: P21781
  ENSP ID: ENSP00000453048

SEQ ID NO: 31894 - protein, 122 aa, Homo sapiens
  Payload ID: 6247
  Gene Symbol: FGF7
  Gene Name: fibroblast growth factor 7
  ENSP ID: ENSP00000453980
MEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTK

SEQ ID NO: 31895 - protein, 97 aa, Homo sapiens
  Payload ID: 6247
  Gene Symbol: FGF7
  Gene Name: fibroblast growth factor 7
  Uniprot ID: P21781
  ENSP ID: ENSP00000454205
MHKWILTWILPTLLYRSCFHIICLVGTISLACNDMTPEQMATNVNCSSPERHTRSYDYMEGGDIRVRRLFCRTQWYLRIDKRGKVKGTQEMKNNYSK

SEQ ID NO: 31896 - protein, 194 aa, Homo sapiens; identical to SEQ ID NO: 31892
  Payload ID: 6247
  Gene Symbol: FGF7
  Gene Name: fibroblast growth factor 7
  Uniprot ID: P21781
  ENSP ID: ENSP00000478148

SEQ ID NO: 31897 - protein, 244 aa, Homo sapiens
  Payload ID: 6248
  Gene Symbol: FGF8
  Gene Name: fibroblast growth factor 8 (androgen-induced)
  Uniprot ID: P55075
  ENSP ID: ENSP00000321797
MGSPRSALSCLLLHLLVLCLQAQEGPGRGPALGRELASLFRAGREPQGVSQQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 31898 - protein, 215 aa, Homo sapiens
  Payload ID: 6248
  Gene Symbol: FGF8
  Gene Name: fibroblast growth factor 8 (androgen-induced)
  Uniprot ID: P55075
  ENSP ID: ENSP00000321945
MGSPRSALSCLLLHLLVLCLQAQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 31899 - protein, 233 aa, Homo sapiens
  Payload ID: 6248
  Gene Symbol: FGF8
  Gene Name: fibroblast growth factor 8 (androgen-induced)
  Uniprot ID: P55075
  ENSP ID: ENSP00000340039
MGSPRSALSCLLLHLLVLCLQAQEGPGRGPALGRELASLFRAGREPQGVSQQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 31900 - protein, 204 aa, Homo sapiens
  Payload ID: 6248
  Gene Symbol: FGF8
  Gene Name: fibroblast growth factor 8 (androgen-induced)
  Uniprot ID: P55075
  ENSP ID: ENSP00000344306
MGSPRSALSCLLLHLLVLCLQAQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 31901 - protein, 37 aa, Homo sapiens
  Payload ID: 6248
  Gene Symbol: FGF8
  Gene Name: fibroblast growth factor 8 (androgen-induced)
  ENSP ID: ENSP00000473299
MGSPRSALSCLLLHLLVLCLQAQVRRGARRRGPGAPV

SEQ ID NO: 31902 - protein, 140 aa, Homo sapiens
  Payload ID: 6248
  Gene Symbol: FGF8
  Gene Name: fibroblast growth factor 8 (androgen-induced)
  ENSP ID: ENSP00000484420
MAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 31903 - protein, 208 aa, Homo sapiens
  Payload ID: 6249
  Gene Symbol: FGF9
  Gene Name: fibroblast growth factor 9
  Uniprot ID: P31371
  ENSP ID: ENSP00000371790
MAPLGEVGNYFGVQDAVPFGNVPVLPVDSPVLLSDHLGQSEAGGLPRGPAVTDLDHLKGILRRRQLYCRTGFHLEIFPNGTIQGTRKDHSRFGILEFISIAVGLVSIRGVDSGLYLGMNEKGELYGSEKLTQECVFREQFEENWYNTYSSNLYKHVDTGRRYYVALNKDGTPREGTRTKRHQKFTHFLPRPVDPDKVPELYKDILSQS

SEQ ID NO: 31904 - protein, 234 aa, Homo sapiens [sequence omitted]

SEQ ID NO: 31905 - protein, 223 aa, Homo sapiens
  Payload ID: 6251
  Gene Symbol: FGFBP2
  Gene Name: fibroblast growth factor binding protein 2
  Uniprot ID: Q9BYJ0
  ENSP ID: ENSP00000259989
MKFVPCLLLVTLSCLGTLGQAPRQKQGSTGEEFHFQTGGRDSCTMRPSSLGQGAGEVWLRVDCRNTDQTYWCEYRGQPSMCQAFAADPKPYWNQALQELRRLHHACQGAPVLRPSVCREAGPQAHMQQVTSSLKGSPEPNQQPEAGTPSLRPKATVKLTEATQLGKDSMEELGKAKPTTRPTAKPTQPGPRPGGNEEAKKKAWEHCWKPFQALCAFLISFFRG

SEQ ID NO: 31906 - protein, 258 aa, Homo sapiens
  Payload ID: 6252
  Gene Symbol: FGFBP3
  Gene Name: fibroblast growth factor binding protein 3
  Uniprot ID: Q8TAT2
  ENSP ID: ENSP00000339067
MTPPKLRASLSPSLLLLLSGCLLAAARREKGAASNVAEPVPGPTGGSSGRFLSPEQHACSWQLLLPAPEAAAGSELALRCQSPDGARHQCAYRGHPERCAAYAARRAHFWKQVLGGLRKKRRPCHDPAPLQARLCAGKKGHGAELRLVPRASPPARPTVAGFAGESKPRARNRGRTRERASGPAAGTPPPQSAPPKENPSERKTNEGKRKAALVPNEERPMGTGPDPDGLDGNAELTETYCAEKWHSLCNFFVNFWNG

SEQ ID NO: 31907 - protein, 731 aa, Homo sapiens
  Payload ID: 6253
  Gene Symbol: FGFR1
  Gene Name: fibroblast growth factor receptor 1
  Uniprot ID: P11362
  ENSP ID: ENSP00000327229
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 31908 - protein, 812 aa, Homo sapiens
  Payload ID: 6253
  Gene Symbol: FGFR1
  Gene Name: fibroblast growth factor receptor 1
  Uniprot ID: P11362
  ENSP ID: ENSP00000337247
MAAVTRDFGEMLLHSGRVLPAEAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 31909 - protein, 367 aa, Homo sapiens
  Payload ID: 6253
  Gene Symbol: FGFR1
  Gene Name: fibroblast growth factor receptor 1
  ENSP ID: ENSP00000340636
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSVPIDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKHSGINSSDAEVLTLFNVTEAQSGEYVCKVSNYIGEANQSAWLTVTRPVAKDCWS

SEQ ID NO: 31910 - protein, 733 aa, Homo sapiens
  Payload ID: 6253
  Gene Symbol: FGFR1
  Gene Name: fibroblast growth factor receptor 1
  Uniprot ID: P11362
  ENSP ID: ENSP00000348537
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 31911 - protein, 820 aa, Homo sapiens
  Payload ID: 6253
  Gene Symbol: FGFR1
  Gene Name: fibroblast growth factor receptor 1
  Uniprot ID: P11362
  ENSP ID: ENSP00000380280
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 31912 - protein, 733 aa, Homo sapiens
  Payload ID: 6253
  Gene Symbol: FGFR1
  Gene Name: fibroblast growth factor receptor 1
  ENSP ID: ENSP00000380292
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKHSGINSSDAEVLTLFNVTEAQSGEYVCKVSNYIGEANQSAWLTVTRPVAKALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 31913 - protein, 820 aa, Homo sapiens; identical to SEQ ID NO: 31911
  Payload ID: 6253
  Gene Symbol: FGFR1
  Gene Name: fibroblast growth factor receptor 1
  Uniprot ID: P11362
  ENSP ID: ENSP00000380297

SEQ ID NO: 31914 - protein, 820 aa, Homo sapiens; identical to SEQ ID NO: 31911
  Payload ID: 6253
  Gene Symbol: FGFR1
  Gene Name: fibroblast growth factor receptor 1
  Uniprot ID: P11362
  ENSP ID: ENSP00000380302

SEQ ID NO: 31915 - protein, 54 aa, Homo sapiens
  Payload ID: 6253
  Gene Symbol: FGFR1
  Gene Name: fibroblast growth factor receptor 1
  ENSP ID: ENSP00000392645
MWSWKCLLFWAVLVTATLCTARPSPTLPEQDALPSSEDDDDDDDSSSEEKETDN

SEQ ID NO: 31916 - protein, 853 aa, Homo sapiens
  Payload ID: 6253
  Gene Symbol: FGFR1
  Gene Name: fibroblast growth factor receptor 1
  Uniprot ID: P11362
  ENSP ID: ENSP00000393312
MEARVSLKRRIELTVEYPWRCGALSPTSNCRTGMWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 31917 - protein, 1 aa, Homo sapiens
  Payload ID: 6253
  Gene Symbol: FGFR1
  Gene Name: fibroblast growth factor receptor 1
  ENSP ID: ENSP00000398318
M

SEQ ID NO: 31918 - protein, 822 aa, Homo sapiens [sequence omitted]

SEQ ID NO: 31919 - protein, 106 aa, Homo sapiens
  Payload ID: 6253
  Gene Symbol: FGFR1
  Gene Name: fibroblast growth factor receptor 1
  ENSP ID: ENSP00000400708
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSP

SEQ ID NO: 31920 - protein, 820 aa, Homo sapiens
  Payload ID: 6253
  Gene Symbol: FGFR1
  Gene Name: fibroblast growth factor receptor 1
  Uniprot ID: P11362
  ENSP ID: ENSP00000432972
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 31921 - protein, 150 aa, Homo sapiens
  Payload ID: 6253
  Gene Symbol: FGFR1
  Gene Name: fibroblast growth factor receptor 1
  Uniprot ID: P11362
  ENSP ID: ENSP00000433163
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSACPDLQEAKWCSASFHSITPLPFGLGTRLSD

SEQ ID NO: 31922 - protein, 145 aa, Homo sapiens
  Payload ID: 6253
  Gene Symbol: FGFR1
  Gene Name: fibroblast growth factor receptor 1
  ENSP ID: ENSP00000433569
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEY

SEQ ID NO: 31923 - protein, 85 aa, Homo sapiens
  Payload ID: 6253
  Gene Symbol: FGFR1
  Gene Name: fibroblast growth factor receptor 1
  ENSP ID: ENSP00000434473
MWSWKCLLFWAVLVTATLCTARPSPTLPEQDALPSSEDDDDDDDSSSEEKETDNTKPNPVAPYWTSPEKMEKKLHAVPAAKTVKF

SEQ ID NO: 31924 - protein, 298 aa, Homo sapiens
  Payload ID: 6253
  Gene Symbol: FGFR1
  Gene Name: fibroblast growth factor receptor 1
  ENSP ID: ENSP00000434712
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGS

SEQ ID NO: 31925 - protein, 134 aa, Homo sapiens
  Payload ID: 6253
  Gene Symbol: FGFR1
  Gene Name: fibroblast growth factor receptor 1
  ENSP ID: ENSP00000434800
VSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELPAAGT

SEQ ID NO: 31926 - protein, 139 aa, Homo sapiens
  Payload ID: 6253
  Gene Symbol: FGFR1
  Gene Name: fibroblast growth factor receptor 1
  ENSP ID: ENSP00000434869
MEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSK

SEQ ID NO: 31927 - protein, 61 aa, Homo sapiens
  Payload ID: 6253
  Gene Symbol: FGFR1
  Gene Name: fibroblast growth factor receptor 1
  ENSP ID: ENSP00000435254
MWSWKCLLFWAVLVTATLCTARPSPTLPEQACPDLQEAKWCSASFHSITPLPFGLGTRLSD

SEQ ID NO: 31928 - protein, 142 aa, Homo sapiens
  Payload ID: 6253
  Gene Symbol: FGFR1
  Gene Name: fibroblast growth factor receptor 1
  ENSP ID: ENSP00000435283
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCI

SEQ ID NO: 31929 - protein, 228 aa, Homo sapiens
  Payload ID: 6253
  Gene Symbol: FGFR1
  Gene Name: fibroblast growth factor receptor 1
  ENSP ID: ENSP00000484553
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKPWKRGRQ

SEQ ID NO: 31930 - protein, 819 aa, Homo sapiens
  Payload ID: 6254
  Gene Symbol: FGFR2
  Gene Name: fibroblast growth factor receptor 2
  Uniprot ID: P21802
  ENSP ID: ENSP00000263451
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31931 - protein, 821 aa, Homo sapiens
  Payload ID: 6254
  Gene Symbol: FGFR2
  Gene Name: fibroblast growth factor receptor 2
  ENSP ID: ENSP00000309878
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVFAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31932 - protein, 669 aa, Homo sapiens
  Payload ID: 6254
  Gene Symbol: FGFR2
  Gene Name: fibroblast growth factor receptor 2
  ENSP ID: ENSP00000337665
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRI

SEQ ID NO: 31933 - protein, 704 aa, Homo sapiens
  Payload ID: 6254
  Gene Symbol: FGFR2
  Gene Name: fibroblast growth factor receptor 2
  Uniprot ID: P21802
  ENSP ID: ENSP00000348559
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31934 - protein, 707 aa, Homo sapiens
  Payload ID: 6254
  Gene Symbol: FGFR2
  Gene Name: fibroblast growth factor receptor 2
  Uniprot ID: P21802
  ENSP ID: ENSP00000350166
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEEKKVSGAVDCHKPPCNPSHLPCVLAVDQ

SEQ ID NO: 31935 - protein, 821 aa, Homo sapiens
  Payload ID: 6254
  Gene Symbol: FGFR2
  Gene Name: fibroblast growth factor receptor 2
  Uniprot ID: P21802
  ENSP ID: ENSP00000351276
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31936 - protein, 254 aa, Homo sapiens
  Payload ID: 6254
  Gene Symbol: FGFR2
  Gene Name: fibroblast growth factor receptor 2
  Uniprot ID: P21802
  ENSP ID: ENSP00000352309
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVGSQGL

SEQ ID NO: 31937 - protein, 680 aa, Homo sapiens
  Payload ID: 6254
  Gene Symbol: FGFR2
  Gene Name: fibroblast growth factor receptor 2
  Uniprot ID: P21802
  ENSP ID: ENSP00000353262
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 31938 - protein, 769 aa, Homo sapiens
  Payload ID: 6254
  Gene Symbol: FGFR2
  Gene Name: fibroblast growth factor receptor 2
  Uniprot ID: P21802
  ENSP ID: ENSP00000358052
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 31939 - protein, 768 aa, Homo sapiens
  Payload ID: 6254
  Gene Symbol: FGFR2
  Gene Name: fibroblast growth factor receptor 2
  Uniprot ID: P21802
  ENSP ID: ENSP00000358054
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNE

SEQ ID NO: 31940 - protein, 707 aa, Homo sapiens
  Payload ID: 6254
  Gene Symbol: FGFR2
  Gene Name: fibroblast growth factor receptor 2
  ENSP ID: ENSP00000358055
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31941 - protein, 705 aa, Homo sapiens
  Payload ID: 6254
  Gene Symbol: FGFR2
  Gene Name: fibroblast growth factor receptor 2
  Uniprot ID: P21802
  ENSP ID: ENSP00000358056
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31942 - protein, 709 aa, Homo sapiens
  Payload ID: 6254
  Gene Symbol: FGFR2
  Gene Name: fibroblast growth factor receptor 2
  Uniprot ID: P21802
  ENSP ID: ENSP00000358057
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31943 - protein, 371 aa, Homo sapiens
  Payload ID: 6254
  Gene Symbol: FGFR2
  Gene Name: fibroblast growth factor receptor 2
  ENSP ID: ENSP00000404219
FSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELNTWTSANLSNSIHLVTLTQEVLVLQEMILFFLQTPCLTNHAFLSIHT

SEQ ID NO: 31944 - protein, 822 aa, Homo sapiens
  Payload ID: 6254
  Gene Symbol: FGFR2
  Gene Name: fibroblast growth factor receptor 2
  Uniprot ID: P21802
  ENSP ID: ENSP00000410294
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31945 - protein, 593 aa, Homo sapiens
  Payload ID: 6254
  Gene Symbol: FGFR2
  Gene Name: fibroblast growth factor receptor 2
  ENSP ID: ENSP00000474011
MCLNKTKQLFGVAKRLPFWRKERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31946 - protein, 251 aa, Homo sapiens
  Payload ID: 6254
  Gene Symbol: FGFR2
  Gene Name: fibroblast growth factor receptor 2
  ENSP ID: ENSP00000474109
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQGRRC

SEQ ID NO: 31947 - protein, 136 aa, Homo sapiens
  Payload ID: 6254
  Gene Symbol: FGFR2
  Gene Name: fibroblast growth factor receptor 2
  ENSP ID: ENSP00000481464
  MOD_RES (1)..(1): Any amino acid
XSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKSK

SEQ ID NO: 31948 - protein, 732 aa, Homo sapiens
  Payload ID: 6254
  Gene Symbol: FGFR2
  Gene Name: fibroblast growth factor receptor 2
  ENSP ID: ENSP00000484154
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31949 - protein, 64 aa, Homo sapiens
  Payload ID: 6254
  Gene Symbol: FGFR2
  Gene Name: fibroblast growth factor receptor 2
  ENSP ID: ENSP00000484892
MVSWGRFICLVVVTMATLSLARPSFSLVEDTTLEPEDAISSGDDEDDTDGAEDFVSENSNNKSK

SEQ ID NO: 31950 - protein, 694 aa, Homo sapiens
  Payload ID: 6255
  Gene Symbol: FGFR3
  Gene Name: fibroblast growth factor receptor 3
  Uniprot ID: P22607
  ENSP ID: ENSP00000231803
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 31951 - protein, 806 aa, Homo sapiens
  Payload ID: 6255
  Gene Symbol: FGFR3
  Gene Name: fibroblast growth factor receptor 3
  Uniprot ID: P22607
  ENSP ID: ENSP00000260795
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 31952 - protein, 808 aa, Homo sapiens
  Payload ID: 6255
  Gene Symbol: FGFR3
  Gene Name: fibroblast growth factor receptor 3
  Uniprot ID: P22607
  ENSP ID: ENSP00000339824
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 31953 - protein, 694 aa, Homo sapiens; identical to SEQ ID NO: 31950
  Payload ID: 6255
  Gene Symbol: FGFR3
  Gene Name: fibroblast growth factor receptor 3
  Uniprot ID: P22607
  ENSP ID: ENSP00000412903

SEQ ID NO: 31954 - protein, 806 aa, Homo sapiens; identical to SEQ ID NO: 31951
  Payload ID: 6255
  Gene Symbol: FGFR3
  Gene Name: fibroblast growth factor receptor 3
  Uniprot ID: P22607
  ENSP ID: ENSP00000414914

SEQ ID NO: 31955 - protein, 792 aa, Homo sapiens
  Payload ID: 6255
  Gene Symbol: FGFR3
  Gene Name: fibroblast growth factor receptor 3
  ENSP ID: ENSP00000420533
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNLVLWGPALGDLHAGGLPVPRHPCGGALQAAEGGPPHGQARQLHTRPVHDHAGVLACRALPEAHLQAAGGGPGPCPYRDVHRRVPGPVGAFRAVLPGWPGHPQLQLLRGRLRVCPRPAAPGPTQQWGLADVKGHWSPTM

SEQ ID NO: 31956 - protein, 112 aa, Homo sapiens
  Payload ID: 6255
  Gene Symbol: FGFR3
  Gene Name: fibroblast growth factor receptor 3
  ENSP ID: ENSP00000427289
NPTPSISWLKNGREFRGEHRIGGIKLRHQQWSLVMESVVPSDRGNYTCVVENKFGSIRQTYTLDVLERSPHRPILQAGLPANQTAVLGSDVEFHCKTAGANTTDKELEVLSL

SEQ ID NO: 31957 - protein, 364 aa, Homo sapiens
  Payload ID: 6255
  Gene Symbol: FGFR3
  Gene Name: fibroblast growth factor receptor 3
  ENSP ID: ENSP00000479472
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRADGGR

SEQ ID NO: 31958 - protein, 802 aa, Homo sapiens
  Payload ID: 6256
  Gene Symbol: FGFR4
  Gene Name: fibroblast growth factor receptor 4
  Uniprot ID: P22455
  ENSP ID: ENSP00000292408
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 31959 - protein, 762 aa, Homo sapiens
  Payload ID: 6256
  Gene Symbol: FGFR4
  Gene Name: fibroblast growth factor receptor 4
  Uniprot ID: P22455
  ENSP ID: ENSP00000377254
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPGTGRIPHLTCDSLTPAGRTKSPTLQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 31960 - protein, 734 aa, Homo sapiens
  Payload ID: 6256
  Gene Symbol: FGFR4
  Gene Name: fibroblast growth factor receptor 4
  ENSP ID: ENSP00000377259
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEASSPWSQALPASQAHPWYEACVSPPAAPPCSPASLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 31961 - protein, 72 aa, Homo sapiens
  Payload ID: 6256
  Gene Symbol: FGFR4
  Gene Name: fibroblast growth factor receptor 4
  ENSP ID: ENSP00000395164
MRLLLALLGVLLSVPGPPVLSLEASEEVELASIHLSLCLRERTGLAGRRALSWAAELVSPAWLPAWSSKSRS

SEQ ID NO: 31962 - protein, 108 aa, Homo sapiens
  Payload ID: 6256
  Gene Symbol: FGFR4
  Gene Name: fibroblast growth factor receptor 4
  ENSP ID: ENSP00000422889
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMI

SEQ ID NO: 31963 - protein, 280 aa, Homo sapiens
  Payload ID: 6256
  Gene Symbol: FGFR4
  Gene Name: fibroblast growth factor receptor 4
  ENSP ID: ENSP00000424670
  MOD_RES (1)..(1): Any amino acid
XRYTDIILYASGSLALAVLLLLAGLYRGQALHGRHPRPPATVQKLSRFPLARQSGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSN

SEQ ID NO: 31964 - protein, 201 aa, Homo sapiens
  Payload ID: 6256
  Gene Symbol: FGFR4
  Gene Name: fibroblast growth factor receptor 4
  ENSP ID: ENSP00000424905
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIR

SEQ ID NO: 31965 - protein, 802 aa, Homo sapiens; identical to SEQ ID NO: 31958
  Payload ID: 6256
  Gene Symbol: FGFR4
  Gene Name: fibroblast growth factor receptor 4
  Uniprot ID: P22455
  ENSP ID: ENSP00000424960

SEQ ID NO: 31966 - protein, 114 aa, Homo sapiens
  Payload ID: 6256
  Gene Symbol: FGFR4
  Gene Name: fibroblast growth factor receptor 4
  ENSP ID: ENSP00000426492
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLT

SEQ ID NO: 31967 - protein, 87 aa, Homo sapiens
  Payload ID: 6256
  Gene Symbol: FGFR4
  Gene Name: fibroblast growth factor receptor 4
  ENSP ID: ENSP00000427222
MRLLLALLGVLLSVPGPPVLSLEASEEVELEPCLAPSLEQQEQELTVALGQPVRLCCGRAERGGHWYKEGSRLAPAGRVRGWRGRLE

SEQ ID NO: 31968 - protein, 508 aa, Homo sapiens
  Payload ID: 6257
  Gene Symbol: FRS2
  Gene Name: fibroblast growth factor receptor substrate 2
  Uniprot ID: Q8WU20
  ENSP ID: ENSP00000381083
MGSCCSCPDKDTVPDNHRNKFKVINVDDDGNELGSGIMELTDTELILYTRKRDSVKWHYLCLRRYGYDSNLFSFESGRRCQTGQGIFAFKCARAEELFNMLQEIMQNNSINVVEEPVVERNNHQTELEVPRTPRTPTTPGFAAQNLPNGYPRYPSFGDASSHPSSRHPSVGSARLPSVGEESTHPLLVAEEQVHTYVNTTGVQEERKNRTSVHVPLEARVSNAESSTPKEEPSSIEDRDPQILLEPEGVKFVLGPTPVQKQLMEKEKLEQLGRDQVSGSGANNTEWDTGYDSDERRDAPSVNKLVYENINGLSIPSASGVRRGRLTSTSTSDTQNINNSAQRRTALLNYENLPSLPPVWEARKLSRDEDDNLGPKTPSLNGYHNNLDPMHNYVNTENVTVPASAHKIEYSRRRDCTPTVFNFDIRRPSLEHRQLNYIQVDLEGGSDSDNPQTPKTPTTPLPQTPTRRTELYAVIDIERTAAMSNLQKALPRDDGTSRKTRHNSTDLPM

SEQ ID NO: 31969 - protein, 31 aa, Homo sapiens
  Payload ID: 6257
  Gene Symbol: FRS2
  Gene Name: fibroblast growth factor receptor substrate 2
  ENSP ID: ENSP00000447007
MELTDTELILYTRKRDSVKWHYLCLRRYGYD

SEQ ID NO: 31970 - protein, 508 aa, Homo sapiens; identical to SEQ ID NO: 31968
  Payload ID: 6257
  Gene Symbol: FRS2
  Gene Name: fibroblast growth factor receptor substrate 2
  Uniprot ID: Q8WU20
  ENSP ID: ENSP00000447241

SEQ ID NO: 31971 - protein, 36 aa, Homo sapiens
  Payload ID: 6257
  Gene Symbol: FRS2
  Gene Name: fibroblast growth factor receptor substrate 2
  ENSP ID: ENSP00000447724
MGSCCSCPDKDTVPDNHRNKFKVINVDDDGNELGSG

SEQ ID NO: 31972 - protein, 91 aa, Homo sapiens
  Payload ID: 6257
  Gene Symbol: FRS2
  Gene Name: fibroblast growth factor receptor substrate 2
  ENSP ID: ENSP00000447804
MGSCCSCPDKDTVPDNHRNKFKVINVDDDGNELGSGIMELTDTELILYTRKRDSVKWHYLCLRRYGYDSNLFSFESGRRCQTGQGIFAFKC

SEQ ID NO: 31973 - protein, 10 aa, Homo sapiens
  Payload ID: 6257
  Gene Symbol: FRS2
  Gene Name: fibroblast growth factor receptor substrate 2
  ENSP ID: ENSP00000447978
MGSCCSCPDK

SEQ ID NO: 31974 - protein, 40 aa, Homo sapiens
  Payload ID: 6257
  Gene Symbol: FRS2
  Gene Name: fibroblast growth factor receptor substrate 2
  ENSP ID: ENSP00000449105
MGSCCSCPDKDTVPDNHRNKFKVINVDDDGNELGSGIMEL

SEQ ID NO: 31975 - protein, 33 aa, Homo sapiens
  Payload ID: 6257
  Gene Symbol: FRS2
  Gene Name: fibroblast growth factor receptor substrate 2
  ENSP ID: ENSP00000449111
MGSCCSCPDKDTVPDNHRNKFKVINVDDDGNEL

SEQ ID NO: 31976 - protein, 183 aa, Homo sapiens
  Payload ID: 6257
  Gene Symbol: FRS2
  Gene Name: fibroblast growth factor receptor substrate 2
  ENSP ID: ENSP00000449432
MGSCCSCPDKDTVPDNHRNKFKVINVDDDGNELGSGIMELTDTELILYTRKRDSVKWHYLCLRRYGYDSNLFSFESGRRCQTGQGIFAFKCARAEELFNMLQEIMQNNSINVVEEPVVERNNHQTELEVPRTPRTPTTPGFAAQNLPNGYPRYPSFGDASSHPSSRHPSVGSARLPSVGEEST

SEQ ID NO: 31977 - protein, 12 aa, Homo sapiens
  Payload ID: 6257
  Gene Symbol: FRS2
  Gene Name: fibroblast growth factor receptor substrate 2
  ENSP ID: ENSP00000450000
MGSCCSCPDKDT

SEQ ID NO: 31978 - protein, 508 aa, Homo sapiens; identical to SEQ ID NO: 31968
  Payload ID: 6257
  Gene Symbol: FRS2
  Gene Name: fibroblast growth factor receptor substrate 2
  Uniprot ID: Q8WU20
  ENSP ID: ENSP00000450048

SEQ ID NO: 31979 - protein, 492 aa, Homo sapiens
  Payload ID: 6258
  Gene Symbol: FRS3
  Gene Name: fibroblast growth factor receptor substrate 3
  Uniprot ID: O43559
  ENSP ID: ENSP00000259748
MGSCCSCLNRDSVPDNHPTKFKVTNVDDEGVELGSGVMELTQSELVLHLHRREAVRWPYLCLRRYGYDSNLFSFESGRRCQTGQGIFAFKCSRAEEIFNLLQDLMQCNSINVMEEPVIITRNSHPAELDLPRAPQPPNALGYTVSSFSNGCPGEGPRFSAPRRLSTSSLRHPSLGEESTHALIAPDEQSHTYVNTPASEDDHRRGRHCLQPLPEGQAPFLPQARGPDQRDPQVFLQPGQVKFVLGPTPARRHMVKCQGLCPSLHDPPHHNNNNEAPSECPAQPKCTYENVTGGLWRGAGWRLSPEEPGWNGLAHRRAALLHYENLPPLPPVWESQAQQLGGEAGDDGDSRDGLTPSSNGFPDGEEDETPLQKPTSTRAAIRSHGSFPVPLTRRRGSPRVFNFDFRRPGPEPPRQLNYIQVELKGWGGDRPKGPQNPSSPQAPMPTTHPARSSDSYAVIDLKKTVAMSNLQRALPRDDGTARKTRHNSTDLPL

SEQ ID NO: 31980 - protein, 492 aa, Homo sapiens; identical to SEQ ID NO: 31979
  Payload ID: 6258
  Gene Symbol: FRS3
  Gene Name: fibroblast growth factor receptor substrate 3
  Uniprot ID: O43559
  ENSP ID: ENSP00000362109

SEQ ID NO: 31981 - protein, 147 aa, Homo sapiens
  Payload ID: 6258
  Gene Symbol: FRS3
  Gene Name: fibroblast growth factor receptor substrate 3
  ENSP ID: ENSP00000396715
METPRRARSPVSPQFPGQAGCSDTMGSCCSCLNRDSVPDNHPTKFKVTNVDDEGVELGSGVMELTQSELVLHLHRREAVRWPYLCLRRYGYDSNLFSFESGRRCQTGQGIFAFKCSRAEEIFNLLQDLMQCNSINVMEEPVIITRNS

SEQ ID NO: 31982 - protein, 36 aa, Homo sapiens
  Payload ID: 6258
  Gene Symbol: FRS3
  Gene Name: fibroblast growth factor receptor substrate 3
  ENSP ID: ENSP00000413214
MGSCCSCLNRDSVPDNHPTKFKVTNVDDEGVELGSG

SEQ ID NO: 31983 - protein, 504 aa, Homo sapiens
  Payload ID: 6259
  Gene Symbol: FGFRL1
  Gene Name: fibroblast growth factor receptor-like 1
  Uniprot ID: Q8N441
  ENSP ID: ENSP00000264748
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 31984 - protein, 504 aa, Homo sapiens; identical to SEQ ID NO: 31983
  Payload ID: 6259
  Gene Symbol: FGFRL1
  Gene Name: fibroblast growth factor receptor-like 1
  Uniprot ID: Q8N441
  ENSP ID: ENSP00000381498

SEQ ID NO: 31985 - protein, 504 aa, Homo sapiens; identical to SEQ ID NO: 31983
  Payload ID: 6259
  Gene Symbol: FGFRL1
  Gene Name: fibroblast growth factor receptor-like 1
  Uniprot ID: Q8N441
  ENSP ID: ENSP00000423091

SEQ ID NO: 31986 - protein, 152 aa, Homo sapiens
  Payload ID: 6259
  Gene Symbol: FGFRL1
  Gene Name: fibroblast growth factor receptor-like 1
  ENSP ID: ENSP00000424037
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQP

SEQ ID NO: 31987 - protein, 504 aa, Homo sapiens; identical to SEQ ID NO: 31983
  Payload ID: 6259
  Gene Symbol: FGFRL1
  Gene Name: fibroblast growth factor receptor-like 1
  Uniprot ID: Q8N441
  ENSP ID: ENSP00000425025

SEQ ID NO: 31988 - protein, 80 aa, Homo sapiens
  Payload ID: 6259
  Gene Symbol: FGFRL1
  Gene Name: fibroblast growth factor receptor-like 1
  ENSP ID: ENSP00000426740
MTPSPLLLLLLPPLLLGAFPPAAAARGPPKMADKVVPRQVARLGRTVRLQCPVEGDPPPLTMWTKDGRTIHSGWSRFRVL

SEQ ID NO: 31989 - protein, 376 aa, Homo sapiens
  Payload ID: 6260
  Gene Symbol: FMOD
  Gene Name: fibromodulin
  Uniprot ID: Q06828
  ENSP ID: ENSP00000347041
MQWTSLLLLAGLFSLSQAQYEDDPHWWFHYLRSQQSTYYDPYDPYPYETYEPYPYGVDEGPAYTYGSPSPPDPRDCPQECDCPPNFPTAMYCDNRNLKYLPFVPSRMKYVYFQNNQITSIQEGVFDNATGLLWIALHGNQITSDKVGRKVFSKLRHLERLYLDHNNLTRMPGPLPRSLRELHLDHNQISRVPNNALEGLENLTALYLQHNEIQEVGSSMRGLRSLILLDLSYNHLRKVPDGLPSALEQLYMEHNNVYTVPDSYFRGAPKLLYVRLSHNSLTNNGLASNTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 31990 - protein, 2446 aa, Homo sapiens
  Payload ID: 6261
  Gene Symbol: FN1
  Gene Name: fibronectin 1
  Uniprot ID: P02751
  ENSP ID: ENSP00000323534
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 31991 - protein, 2355 aa, Homo sapiens
  Payload ID: 6261
  Gene Symbol: FN1
  Gene Name: fibronectin 1
  Uniprot ID: P02751
  ENSP ID: ENSP00000338200
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 31992 - protein, 2477 aa, Homo sapiens
  Payload ID: 6261
  Gene Symbol: FN1
  Gene Name: fibronectin 1
  Uniprot ID: P02751
  ENSP ID: ENSP00000346839
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 31993 - protein, 2296 aa, Homo sapiens
  Payload ID: 6261
  Gene Symbol: FN1
  Gene Name: fibronectin 1
  Uniprot ID: P02751
  ENSP ID: ENSP00000348285
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 31994 - protein, 2176 aa, Homo sapiens
  Payload ID: 6261
  Gene Symbol: FN1
  Gene Name: fibronectin 1
  Uniprot ID: P02751
  ENSP ID: ENSP00000350534
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 31995 - protein, 2386 aa, Homo sapiens
  Payload ID: 6261
  Gene Symbol: FN1
  Gene Name: fibronectin 1
  Uniprot ID: P02751
  ENSP ID: ENSP00000352696
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 31996 - protein, 241 aa, Homo sapiens
  Payload ID: 6261
  Gene Symbol: FN1
  Gene Name: fibronectin 1
  ENSP ID: ENSP00000392565
YLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQ

SEQ ID NO: 31997 - protein, 2240 aa, Homo sapiens
  Payload ID: 6261
  Gene Symbol: FN1
  Gene Name: fibronectin 1
  Uniprot ID: P02751
  ENSP ID: ENSP00000394423
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 31998 - protein, 657 aa, Homo sapiens
  Payload ID: 6261
  Gene Symbol: FN1
  Gene Name: fibronectin 1
  Uniprot ID: P02751
  ENSP ID: ENSP00000398907
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 31999 - protein, 2267 aa, Homo sapiens
  Payload ID: 6261
  Gene Symbol: FN1
  Gene Name: fibronectin 1
  Uniprot ID: P02751
  ENSP ID: ENSP00000399538
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 32000 - protein, 2330 aa, Homo sapiens
  Payload ID: 6261
  Gene Symbol: FN1
  Gene Name: fibronectin 1
  Uniprot ID: P02751
  ENSP ID: ENSP00000410422
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 32001 - protein, 2265 aa, Homo sapiens
  Payload ID: 6261
  Gene Symbol: FN1
  Gene Name: fibronectin 1
  Uniprot ID: P02751
  ENSP ID: ENSP00000415018
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 32002 - protein, 1103 aa, Homo sapiens
  Payload ID: 6261
  Gene Symbol: FN1
  Gene Name: fibronectin 1
  ENSP ID: ENSP00000416139
LRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 32003 - protein, 674 aa, Homo sapiens
  Payload ID: 6262
  Gene Symbol: FLRT1
  Gene Name: fibronectin leucine rich transmembrane protein 1
  Uniprot ID: Q9NZU1
  ENSP ID: ENSP00000246841
MVVAHPTATATTTPTATVTATVVMTTATMDLRDWLFLCYGLIAFLTEVIDSTTCPSVCRCDNGFIYCNDRGLTSIPADIPDDATTLYLQNNQINNAGIPQDLKTKVNVQVIYLYENDLDEFPINLPRSLRELHLQDNNVRTIARDSLARIPLLEKLHLDDNSVSTVSIEEDAFADSKQLKLLFLSRNHLSSIPSGLPHTLEELRLDDNRISTIPLHAFKGLNSLRRLVLDGNLLANQRIADDTFSRLQNLTELSLVRNSLAAPPLNLPSAHLQKLYLQDNAISHIPYNTLAKMRELERLDLSNNNLTTLPRGLFDDLGNLAQLLLRNNPWFCGCNLMWLRDWVKARAAVVNVRGLMCQGPEKVRGMAIKDITSEMDECFETGPQGGVANAAAKTTASNHASATTPQGSLFTLKAKRPGLRLPDSNIDYPMATGDGAKTLAIHVKALTADSIRITWKATLPASSFRLSWLRLGHSPAVGSITETLVQGDKTEYLLTALEPKSTYIICMVTMETSNAYVADETPVCAKAETADSYGPTTTLNQEQNAGPMASLPLAGIIGGAVALVFLFLVLGAICWYVHQAGELLTRERAYNRGSRKKDDYMESGTKKDNSILEIRGPGLQMLPINPYRAKEEYVVHTIFPSNGSSLCKATHTIGYGTTRGYRDGGIPDIDYSYT

SEQ ID NO: 32004 - protein, 660 aa, Homo sapiens
  Payload ID: 6263
  Gene Symbol: FLRT2
  Gene Name: fibronectin leucine rich transmembrane protein 2
  Uniprot ID: O43155
  ENSP ID: ENSP00000332879
MGLQTTKWPSHGAFFLKSWLIISLGLYSQVSKLLACPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVFDNLSNLKQLTARNNPWFCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 32005 - protein, 660 aa, Homo sapiens; identical to SEQ ID NO: 32004
  Payload ID: 6263
  Gene Symbol: FLRT2
  Gene Name: fibronectin leucine rich transmembrane protein 2
  Uniprot ID: O43155
  ENSP ID: ENSP00000451050

SEQ ID NO: 32006 - protein, 649 aa, Homo sapiens
  Payload ID: 6264
  Gene Symbol: FLRT3
  Gene Name: fibronectin leucine rich transmembrane protein 3
  Uniprot ID: Q9NZU0
  ENSP ID: ENSP00000339912
MISAAWSIFLIGTKIGLFLQVAPLSVMAKSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDHQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLPLAAIIGGAVALVTIALLALVCWYVHRNGSLFSRNCAYSKGRRRKDDYAEAGTKKDNSILEIRETSFQMLPISNEPISKEEFVIHTIFPPNGMNLYKNNHSESSSNRSYRDSGIPDSDHSHS

SEQ ID NO: 32007 - protein, 649 aa, Homo sapiens; identical to SEQ ID NO: 32006
  Payload ID: 6264
  Gene Symbol: FLRT3
  Gene Name: fibronectin leucine rich transmembrane protein 3
  Uniprot ID: Q9NZU0
  ENSP ID: ENSP00000367292

SEQ ID NO: 32008 - protein, 133 aa, Homo sapiens
  Payload ID: 6265
  Gene Symbol: FANK1
  Gene Name: fibronectin type III and ankyrin repeat domains 1
  ENSP ID: ENSP00000357678
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTSSIWLGGEPISSEHLHRAVSVNDEDLLVRILQGG

SEQ ID NO: 32009 - protein, 282 aa, Homo sapiens
  Payload ID: 6265
  Gene Symbol: FANK1
  Gene Name: fibronectin type III and ankyrin repeat domains 1
  ENSP ID: ENSP00000357680
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTSSIWLGGEPISSEHLHRAVSVNDEDLLVRILQGGRVKVDVPNKFGFTALMVAAQKGYTSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMSVVSLLEERKKKQRPKKSCVC

SEQ ID NO: 32010 - protein, 345 aa, Homo sapiens
  Payload ID: 6265
  Gene Symbol: FANK1
  Gene Name: fibronectin type III and ankyrin repeat domains 1
  Uniprot ID: Q8TC84
  ENSP ID: ENSP00000357682
MEPQKIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 32011 - protein, 339 aa, Homo sapiens
  Payload ID: 6265
  Gene Symbol: FANK1
  Gene Name: fibronectin type III and ankyrin repeat domains 1
  ENSP ID: ENSP00000357684
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 32012 - protein, 123 aa, Homo sapiens
  Payload ID: 6265
  Gene Symbol: FANK1
  Gene Name: fibronectin type III and ankyrin repeat domains 1
  ENSP ID: ENSP00000396356
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRI

SEQ ID NO: 32013 - protein, 199 aa, Homo sapiens
  Payload ID: 6265
  Gene Symbol: FANK1
  Gene Name: fibronectin type III and ankyrin repeat domains 1
  ENSP ID: ENSP00000412737
  MOD_RES (1)..(1): Any amino acid
XEPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMSVVSLLEERKKKQRPKKSCVC

SEQ ID NO: 32014 - protein, 132 aa, Homo sapiens
  Payload ID: 6265
  Gene Symbol: FANK1
  Gene Name: fibronectin type III and ankyrin repeat domains 1
  ENSP ID: ENSP00000415719
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTSSIWLGGEPISSEHLHRAVSVNDEDLLVRILQG

SEQ ID NO: 32015 - protein, 496 aa, Homo sapiens
  Payload ID: 6266
  Gene Symbol: FSD1
  Gene Name: fibronectin type III and SPRY domain containing 1
  Uniprot ID: Q9BTV5
  ENSP ID: ENSP00000221856
MEEQREALRKIIKTLAVKNEEIQSFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPVPSAPVIDLAESLVADNCVTLVWRMPDEDSKIDHYVLEYRRTNFEGPPRLKEDQPWMVIEGIRQTEYTLTGLKFDMKYMNFRVKACNKAVAGEFSEPVTLETPAFMFRLDASTSHQNLRVDDLSVEWDAMGGKVQDIKAREKDGKGRTASPINSPARGTPSPKRMPSGRGGRDRFTAESYTVLGDTLIDGGEHYWEVRYEPDSKAFGVGVAYRSLGRFEQLGKTAASWCLHVNNWLQVSFTAKHANKVKVLDAPVPDCLGVHCDFHQGLLSFYNARTKQVLHTFKTRFTQPLLPAFTVWCGSFQVTTGLQVPSAVRCLQKRGSATSSSNTSLT

SEQ ID NO: 32016 - protein, 126 aa, Homo sapiens
  Payload ID: 6266
  Gene Symbol: FSD1
  Gene Name: fibronectin type III and SPRY domain containing 1
  ENSP ID: ENSP00000469629
  MOD_RES (1)..(1): Any amino acid
XPDSKAFGVGVAYRSLGRFEQLGKTAASWCLHVNNWLQVSFTAKHANKVKVLDAPVPDCLGLLSFYNARTKQVLHTFKTRFTQPLLPAFTVWCGSFQVTTGLQVPSAVRCLQKRGSATSSSNTSLT

SEQ ID NO: 32017 - protein, 65 aa, Homo sapiens
  Payload ID: 6266
  Gene Symbol: FSD1
  Gene Name: fibronectin type III and SPRY domain containing 1
  ENSP ID: ENSP00000472060
MEEQREALRKIIKTLAVKNEEIQSFIYSLKQMLLNVEANSAKVRYEPDSKAFGVGVAYRSLGRFE

SEQ ID NO: 32018 - protein, 176 aa, Homo sapiens
  Payload ID: 6266
  Gene Symbol: FSD1
  Gene Name: fibronectin type III and SPRY domain containing 1
  ENSP ID: ENSP00000472521
  MOD_RES (1)..(1): Any amino acid
XFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPVPSAPVIDLAESLVPSAVRCLQKRGSATSSSNTSLT

SEQ ID NO: 32019 - protein, 437 aa, Homo sapiens
  Payload ID: 6266
  Gene Symbol: FSD1
  Gene Name: fibronectin type III and SPRY domain containing 1
  ENSP ID: ENSP00000473022
MEEQREALRKIIKTLAVKNEEIQSFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPVPSAPVIDLAESLVADNCVTLVWRMPDEDSKIDHYVLEYRRTNFEGPPRLKEDQPWMVIEGIRQTEYTLTGLKFDMKYMNFRVKACNKAVAGEFSEPVTLETPAFMFRLDASTSHQNLRVDDLSVEWDAMGGKVQDIKAREKDGKGRTASPINSPARGTPSPKRMPSGRGGRDRFTAESYTVLGDTLIDGGEHYWEVRYEPDSKAFGVGVAYRSLGRFEQLGKTAASWCLHVNNWLQASCPSTMPAPNKCCTLSRPGSHSRCCLLSRYGVAASR

SEQ ID NO: 32020 - protein, 311 aa, Homo sapiens
  Payload ID: 6267
  Gene Symbol: FSD1L
  Gene Name: fibronectin type III and SPRY domain containing 1-like
  ENSP ID: ENSP00000363839
MPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGRSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 32021 - protein, 508 aa, Homo sapiens
  Payload ID: 6267
  Gene Symbol: FSD1L
  Gene Name: fibronectin type III and SPRY domain containing 1-like
  ENSP ID: ENSP00000363842
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKAARQIKDRVTMASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGSVHVTSLKKHTSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 32022 - protein, 509 aa, Homo sapiens
  Payload ID: 6267
  Gene Symbol: FSD1L
  Gene Name: fibronectin type III and SPRY domain containing 1-like
  ENSP ID: ENSP00000378384
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKAARQIKDRVTMASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGSVHVTSLKKHTRSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 32023 - protein, 530 aa, Homo sapiens
  Payload ID: 6267
  Gene Symbol: FSD1L
  Gene Name: fibronectin type III and SPRY domain containing 1-like
  Uniprot ID: Q9BXM9
  ENSP ID: ENSP00000417492
MDSQKYCFKENENVTVDKACFLISNITIGPESINLQQEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKAARQIKDRVTMASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGRSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 32024 - protein, 497 aa, Homo sapiens
  Payload ID: 6267
  Gene Symbol: FSD1L
  Gene Name: fibronectin type III and SPRY domain containing 1-like
  ENSP ID: ENSP00000419691
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKAARQIKDRVTMASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 32025 - protein, 381 aa, Homo sapiens
  Payload ID: 6267
  Gene Symbol: FSD1L
  Gene Name: fibronectin type III and SPRY domain containing 1-like
  ENSP ID: ENSP00000420624
MDSQKYCFKENENVTVDKACFLISNITIGPESINLQQEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKAARQIKDRVTMASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGSYKFLKIVFLLSKELLIHFEAVLSEIFLFICMTFTFYLLP

SEQ ID NO: 32026 - protein, 145 aa, Homo sapiens
  Payload ID: 6267
  Gene Symbol: FSD1L
  Gene Name: fibronectin type III and SPRY domain containing 1-like
  Uniprot ID: Q9BXM9
  ENSP ID: ENSP00000487223
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKVHKNCINTLNKGSCIFKKAFLFFFSFGFLY

SEQ ID NO: 32027 - protein, 749 aa, Homo sapiens
  Payload ID: 6268
  Gene Symbol: FSD2
  Gene Name: fibronectin type III and SPRY domain containing 2
  Uniprot ID: A1L4K1
  ENSP ID: ENSP00000335651
MEEESGEELGLDRSTPKDFHFYHMDLYDSEDRLHLFPEENTRMRKVVQAEMANESRGAGDGKAQRDLQEEVDELVHLYGLEDDHELGDEFVDENIPRTGVSEYPPYMMKRRDPAREQRDWRLSGEAAEAEDLGFGGWGSAGQCQDLREAYRYTHGRASEEYECYVIPEEEDEEEAADVFCVTCKTPIRAFQKVFDEHKEHEVIPLNEALESAKDEIHKNMYKLEKQIIEMENFANHLEEVFITVEENFGKQEQNFESHYNEILETLAQKYEEKIQALGEKKKEKLEALYGQLVSCGENLDTCKELMETIEEMCHEEKVDFIKDAVAMADRLGKFLKTKTDVEISAQPEFEDQTLDFSDVEQLMGSINTIPAPSAPVINPQVPNSATGSSVRVCWSLYSDDTVESYQLSYRPVQDSSPGTDQAEFTVTVKETYCSVTNLVPNTQYEFWVTAHNRAGPSPSSERAVYMTAPSPPIIKTKEIRSCEEAVLICWESGNLNPVDSYTVELTQAESPEASGVTESVVGIPTCESVVQLQPGRSYIIYVRALNMGGPSVRSEPATVHTIGSYFRLNKDTCHPWLTISEDGLTAVRSERRTPARELSPSDTHFTRCVAVMGNLIPVRGHHYWEVEVDEHLDYRVGVAFADVRKQEDLGANCLSWCMRHTFASSRHKYEFLHNRTTPDIRITVPPKKIGILLDYEHSKLSFFNVDLSQHLYTFSCQLHEFVHPCFSLEKPGCLKVHNGISMPKHVTFY

SEQ ID NO: 32028 - protein, 704 aa, Homo sapiens
  Payload ID: 6268
  Gene Symbol: FSD2
  Gene Name: fibronectin type III and SPRY domain containing 2
  Uniprot ID: A1L4K1
  ENSP ID: ENSP00000444078
MEEESGEELGLDRSTPKDFHFYHMDLYDSEDRLHLFPEENTRMRKVVQAEMANESRGAGDGKAQRDLQEEVDELVHLYGLEDDHELGDEFVDENIPRTGVSEYPPYMMKRRDPAREQRDWRLSGEAAEAEDLGFGGWGSAGQCQDLREAYRYTHGRASEEYECYVIPEEEDEEEAADVFCVTCKTPIRAFQKVFDEHKEHEVIPLNEALESAKDEIHKNMYKLEKQIIEMENFANHLEEVFITVEENFGKQEQNFESHYNEILETLAQKYEEKIQALGEKKKEKLEALYGQLVSCGENLDTCKELMETIEEMCHEEKVDFIKDAVAMADRLGKFLKTKTDVEISAQPEFEDQTLDFSDVEQLMGSINTIPAPSAPVINPQVPNSATGSSVRVCWSLYSDDTVESYQLSYRPVQDSSPGTDQAAPSPPIIKTKEIRSCEEAVLICWESGNLNPVDSYTVELTQAESPEASGVTESVVGIPTCESVVQLQPGRSYIIYVRALNMGGPSVRSEPATVHTIGSYFRLNKDTCHPWLTISEDGLTAVRSERRTPARELSPSDTHFTRCVAVMGNLIPVRGHHYWEVEVDEHLDYRVGVAFADVRKQEDLGANCLSWCMRHTFASSRHKYEFLHNRTTPDIRITVPPKKIGILLDYEHSKLSFFNVDLSQHLYTFSCQLHEFVHPCFSLEKPGCLKVHNGISMPKHVTFY

SEQ ID NO: 32029 - protein, 101 aa, Homo sapiens
  Payload ID: 6268
  Gene Symbol: FSD2
  Gene Name: fibronectin type III and SPRY domain containing 2
  ENSP ID: ENSP00000453127
MEEESGEELGLDRSTPKDFHFYHMDLYDSEDRLHLFPEENTRMRKVVQAEMANESRGAGDGKAQRDLQEEVDELVHLYGLEDDHELGDEFVDENIPRTGVS

SEQ ID NO: 32030 - protein, 1894 aa, Homo sapiens
  Payload ID: 6269
  Gene Symbol: FNDC1
  Gene Name: fibronectin type III domain containing 1
  Uniprot ID: Q4ZHG4
  ENSP ID: ENSP00000297267
MAPEAGATLRAPRRLSWAALLLLAALLPVASSAAASVDHPLKPRHVKLLSTKMGLKVTWDPPKDATSRPVEHYNIAYGKSLKSLKYIKVNAETYSFLIEDVEPGVVYFVLLTAENHSGVSRPVYRAESPPGGEWIEIDGFPIKGPGPFNETVTEKEVPNKPLRVRVRSSDDRLSVAWKAPRLSGAKSPRRSRGFLLGYGESGRKMNYVPLTRDERTHEIKKLASESVYVVSLQSMNSQGRSQPVYRAALTKRKISEEDELDVPDDISVRVMSSQSVLVSWVDPVLEKQKKVVASRQYTVRYREKGELARWDYKQIANRRVLIENLIPDTVYEFAVRISQGERDGKWSTSVFQRTPESAPTTAPENLNVWPVNGKPTVVAASWDALPETEGKVKEYILSYAPALKPFGAKSLTYPGDTTSALVDGLQPGERYLFKIRATNRRGLGPHSKAFIVAMPTTSKADVEQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAASLPKHQQVESPTGAGAGGDHRSQRGHAASPARPSRPGGPQSRARVPSRAAPGKSEPPSKRPLSSKSQQSVSAEDDEEEDAGFFKGGKEDLLSSSVPKWPSSSTPRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 32031 - protein, 1790 aa, Homo sapiens
  Payload ID: 6269
  Gene Symbol: FNDC1
  Gene Name: fibronectin type III domain containing 1
  ENSP ID: ENSP00000333297
  MOD_RES (1)..(1): Any amino acid
XPRHVKLLSTKMGLKVTWDPPKDATSRPVEHYNIAYGKSLKSLKYIKVNAETYSFLIEDVEPGVVYFVLLTAENHSGVSRPVYRAESPPGGEWIEIDGFPIKGPGPFNETVTEKEVPNKPLRVRVRSSDDRLSVAWKAPRLSGAKSPRRSRGFLLGYGESGRKMNYVPLTRDERTHEIKKLASESVYVVSLQSMNSQGRSQPVYRAALTKRKISEEDELDVPDDISVRVMSSQSVLVSWVDPVLEKQKKVVASRQYTVRYREKGELARWDYKQIANRRVLIENLIPDTVYEFAVRISQGERDGKWSTSVFQRTPESAPTTAPENLNVWPVNGKPTVVAASWDALPETEGKVKASKADVEQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAASLPKHQQVESPTGAGAGGDHRSQRGHAASPARPSRPGGPQSRARVPSRAAPGKSEPPSKRPLSSKSQQSVSAEDDEEEDAGFFKGGKEDLLSSSVPKWPSSSTPRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 32032 - protein, 1142 aa, Homo sapiens
  Payload ID: 6270
  Gene Symbol: FNDC3A
  Gene Name: fibronectin type III domain containing 3A
  Uniprot ID: Q9Y2H6
  ENSP ID: ENSP00000381362
MSGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 32033 - protein, 1198 aa, Homo sapiens
  Payload ID: 6270
  Gene Symbol: FNDC3A
  Gene Name: fibronectin type III domain containing 3A
  Uniprot ID: Q9Y2H6
  ENSP ID: ENSP00000417257
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 32034 - protein, 139 aa, Homo sapiens
  Payload ID: 6270
  Gene Symbol: FNDC3A
  Gene Name: fibronectin type III domain containing 3A
  ENSP ID: ENSP00000418703
VGKVTSYIINNLQPDTTYRIRIQALNSLGAGPFSHMIKLKTKPLPPDPPRLECVAFSHQNLKLKWGEGTPKTLSTDSIQYHLQMEDKNGRNIQSKIMGCIQLIDNILGEICMIFNFIEQFKWVCIPIQRTMSYIQSTKT

SEQ ID NO: 32035 - protein, 684 aa, Homo sapiens
  Payload ID: 6270
  Gene Symbol: FNDC3A
  Gene Name: fibronectin type III domain containing 3A
  ENSP ID: ENSP00000420275
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQTPSG

SEQ ID NO: 32036 - protein, 1198 aa, Homo sapiens; identical to SEQ ID NO: 32033
  Payload ID: 6270
  Gene Symbol: FNDC3A
  Gene Name: fibronectin type III domain containing 3A
  Uniprot ID: Q9Y2H6
  ENSP ID: ENSP00000441831

SEQ ID NO: 32037 - protein, 326 aa, Homo sapiens
  Payload ID: 6270
  Gene Symbol: FNDC3A
  Gene Name: fibronectin type III domain containing 3A
  ENSP ID: ENSP00000484320
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYV

SEQ ID NO: 32038 - protein, 1204 aa, Homo sapiens
  Payload ID: 6271
  Gene Symbol: FNDC3B
  Gene Name: fibronectin type III domain containing 3B
  Uniprot ID: Q53EP0
  ENSP ID: ENSP00000338523
MYVTMMMTDQIPLELPPLLNGEVAMMPHLVNGDAAQQVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSTYITREDQYSKPPHKKLKDRQIDRQNRLNSPPSSIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTSGYSQEVVCYTLGNIPQMPSAPRLVRAGITWVTLQWSKPEGCSPEEVITYTLEIQEDENDNLFHPKYTGEDLTCTVKNLKRSTQYKFRLTASNTEGKSCPSEVLVCTTSPDRPGPPTRPLVKGPVTSHGFSVKWDPPKDNGGSEILKYLLEITDGNSEANQWEVAYSGSATEYTFTHLKPGTLYKLRACCISTGGHSQCSESLPVRTLSIAPGQCRPPRVLGRPKHKEVHLEWDVPASESGCEVSEYSVEMTEPEDVASEVYHGPELECTVGNLLPGTVYRFRVRALNDGGYGPYSDVSEITTAAGPPGQCKAPCISCTPDGCVLVGWESPDSSGADISEYRLEWGEDEESLELIYHGTDTRFEIRDLLPAAQYCCRLQAFNQAGAGPYSELVLCQTPASAPDPVSTLCVLEEEPLDAYPDSPSACLVLNWEEPCNNGSEILAYTIDLGDTSITVGNTTMHVMKDLLPETTYRIRIQAINEIGAGPFSQFIKAKTRPLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 32039 - protein, 208 aa, Homo sapiens
  Payload ID: 6271
  Gene Symbol: FNDC3B
  Gene Name: fibronectin type III domain containing 3B
  ENSP ID: ENSP00000389064
MFTKEKIWSEVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSTYITREDQYSKPPHKKLKDRQIDRQNRLNSPPSSIYKSSCTTVYNGYGKGHSGGSGG

SEQ ID NO: 32040 - protein, 1204 aa, Homo sapiens; identical to SEQ ID NO: 32038
  Payload ID: 6271
  Gene Symbol: FNDC3B
  Gene Name: fibronectin type III domain containing 3B
  Uniprot ID: Q53EP0
  ENSP ID: ENSP00000389094

SEQ ID NO: 32041 - protein, 71 aa, Homo sapiens
  Payload ID: 6271
  Gene Symbol: FNDC3B
  Gene Name: fibronectin type III domain containing 3B
  Uniprot ID: Q53EP0
  ENSP ID: ENSP00000392471
MYVTMMMTDQIPLELPPLLNGEVAMMPHLVNGDAAQQVILVQVNPGETFTIRAEDGTLQCIQDEVVKRACD

SEQ ID NO: 32042 - protein, 71 aa, Homo sapiens; identical to SEQ ID NO: 32041
  Payload ID: 6271
  Gene Symbol: FNDC3B
  Gene Name: fibronectin type III domain containing 3B
  Uniprot ID: Q53EP0
  ENSP ID: ENSP00000408496

SEQ ID NO: 32043 - protein, 1204 aa, Homo sapiens; identical to SEQ ID NO: 32038
  Payload ID: 6271
  Gene Symbol: FNDC3B
  Gene Name: fibronectin type III domain containing 3B
  Uniprot ID: Q53EP0
  ENSP ID: ENSP00000411242

SEQ ID NO: 32044 - protein, 234 aa, Homo sapiens
  Payload ID: 6272
  Gene Symbol: FNDC4
  Gene Name: fibronectin type III domain containing 4
  Uniprot ID: Q9H6D8
  ENSP ID: ENSP00000264703
MPSGCHSSPPSGLRGDMASLVPLSPYLSPTVLLLVSCDLGFVRADRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPLQTGEVVIIVVVLLMWAAVIGLFCRQYDIIKDNDSNNNPKEKGKGPEQSPQGRPVGTRQKKSPSINTIDV

SEQ ID NO: 32045 - protein, 212 aa, Homo sapiens
  Payload ID: 6273
  Gene Symbol: FNDC5
  Gene Name: fibronectin type III domain containing 5
  ENSP ID: ENSP00000362570
IHPGSPSAWPPRARAALRLWLGCVCFALVQADSPSAPVNVTVRHLKANSAVVSWDVLEDEVVIGFAISQQKKDVRMLRFIQEVNTTTRSCALWDLEEDTEYIVHVQAISIQGQSPASEPVLFKTPREAEKMASKNKDEVTMKEMGRNQQLRTGEVLIIVVVLFMWAGVIALFCRQYDIIKDNEPNNNKEKTKSASETSTPEHQGGGLLRSKI

SEQ ID NO: 32046 - protein, 153 aa, Homo sapiens
  Payload ID: 6273
  Gene Symbol: FNDC5
  Gene Name: fibronectin type III domain containing 5
  Uniprot ID: Q8NAU1
  ENSP ID: ENSP00000476320
MLRFIQEVNTTTRSCALWDLEEDTEYIVHVQAISIQGQSPASEPVLFKTPREAEKMASKNKDEVTMKEMGRNQQLRTGEVLIIVVVLFMWAGVIALFCRQYDIIKDNEPNNNKEKTKSASETSTPEHQGGGLLRSKVRARPGPGWATLCLMLW

SEQ ID NO: 32047 - protein, 733 aa, Homo sapiens
  Payload ID: 6274
  Gene Symbol: FNDC7
  Gene Name: fibronectin type III domain containing 7
  Uniprot ID: Q5VTL7
  ENSP ID: ENSP00000359034
MAGGRETCLPLIGFILICLKMVASAKSAPEIPTIDQAYSKLSNSITVEWATVPGATSYLLTAEDGDTVIETTVANSPGTVTGLKAATWYEITIRSISAAGRSQASPPKQAKTVLAAPILEVSSPSSDSILVQWEAVYMAIAFSVSIMRANGLGSIWKENTTNTSLTFTSLEAGTLYTIKAYAWNANRIPGDDSTCNQRTSPRAPANIQVSFDSGALKASFSWARAEGAFNYTVMALSDSSELTCSTTFSSCTISSLQCGTEYLISVLASNDAGSSKSSSAMTLKTVACAPGRVTIQEDPPGHLSVAWSSVDLGDYYVVFVKSDDGLEVHCNTSLTQCNFLSECGFTYFISVFVYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFITTAPCSPEIKNVSRDAFSMINVHWRSTNDDATYTVTAQGEKGLYQCSSTGESCTMRGLPCGSVFSVTAVAETQAGRSLPSYSVPLETVPCCPTGLTVTQITQSVINVSWTIGRVAQTHVAVLESHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVTCSGSTLGMVIYRGKRNEE

SEQ ID NO: 32048 - protein, 499 aa, Homo sapiens
  Payload ID: 6274
  Gene Symbol: FNDC7
  Gene Name: fibronectin type III domain containing 7
  ENSP ID: ENSP00000405986
  MOD_RES (1)..(1): Any amino acid
XEGAFNYTVMALSDSSELTCSTTFSSCTISSLQCGTEYLISVLASNDAGSSKSSSAMTLKTVACAPGRVTIQEDPPGHLSVAWSSVDLGDYYVVFVKSDDGLEVHCNTSLTQCNFLSECGFTYFISVFVYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFITTAPCSPEIKNVSRDAFSMINVHWRSTNDDATYTVTAQGEKGLYQCSSTGESCTMRGLPCGSVFSVTAVAETQAGRSLPSYSVPLETVPCCPTGLTVTQITQSVINVSWTIGRVAQTHVAVLESHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVIYRGKRNEE

SEQ ID NO: 32049 - protein, 324 aa, Homo sapiens
  Payload ID: 6275
  Gene Symbol: FNDC8
  Gene Name: fibronectin type III domain containing 8
  Uniprot ID: Q8TC99
  ENSP ID: ENSP00000158009
MASEALHQVGDGEEAVLKKENFNMMNALDQLPKPFSNPKSMNRTVTTKGLPLASKGNLVNFLEDDTINLLKPLPVEDSDCSSDETSISAFSSTLLNPIKLAVTQPNSSFFAGMLEGELNKLSFSPMAKNAENEDLALGPCPCPSKSQMATRGLLDLDNPELETETSSTHSESSVVVDLPDTPFIFEHTVNNSTAVISWTYALGKQPVSFYQLLLQEVAKTQENELPEAKNRPWIFNKILGTTVKLMELKPNTCYCLSVRAANTAGVGKWCKPYKFATLATDFSSFPENYPIQITVRRKEPRQKIVSIGPEEMRRLEDLEYLFPC

SEQ ID NO: 32050 - protein, 224 aa, Homo sapiens
  Payload ID: 6276
  Gene Symbol: FNDC9
  Gene Name: fibronectin type III domain containing 9
  Uniprot ID: Q8TBE3
  ENSP ID: ENSP00000310594
MNIEVGNISYTGAIISWSSSEPCLEDYYHIMYRPNWNSIFSGYLRYSFHHEEKVPRTISSVVLEHLAPSTLYFLCISCKKAAFPYRHYCTMFHTLDKSPLAPGSSLVDPQISLWVLMAILLACFTAVLAFICLQFWCVRCHEPRWSYRAGHMEEANGLVRWPEEAPDLGQREEDLQGLPLVEMPRKNSRDGAELDPEANQDAPDAGALQRGGGDPPAILPHCGE

SEQ ID NO: 32051 - protein, 180 aa, Homo sapiens
  Payload ID: 6276
  Gene Symbol: FNDC9
  Gene Name: fibronectin type III domain containing 9
  ENSP ID: ENSP00000429434
MNIEVGNISYTGAIISWSSSEPCLEDYYHIMYRPNWNSIFSGYLRYSFHHEEKVPRTISSVVLEHLAPSTLYFLCISCKKAAFPYRHYCTMFHTLDKSPLAPGSSLVDPQISLWVLMAILLACFTAVLAFICLQFWCVRCHEPRWSYRAGHMEEANGLVRWPEEAPDLGQREEDLQGLPL

SEQ ID NO: 32052 - protein, 460 aa, Homo sapiens
  Payload ID: 6277
  Gene Symbol: FBRS
  Gene Name: fibrosin
  Uniprot ID: Q9HAH7
  ENSP ID: ENSP00000287468
MFEKYPGKMEGLFRHNPYTAFPPAVPGLPPGLPPAVSFGSLQGAFQPKSTNPELPPRLGPVPSGLSQKGTQIPDHFRPPLRKPGKWCAMHVRVAYMILRHQEKMKGDSHKLDFRNDLLPCLPGPYGALPPGQELSHPASLFTATGAVHAAANPFTAAPGAHGPFLSPSTHIDPFGRPTSFASLAALSNGAFGGLGSPTFNSGAVFAQKESPGAPPAFASPPDPWGRLHRSPLTFPAWVRPPEAARTPGSDKERPVERREPSITKEEKDRDLPFSRPQLRVSPATPKARAGEEGPRPTKESVRVKEERKEEAAAAAAAAAAAAAAAAAAATGPQGLHLLFERPRPPPFLGPSPPDRCAGFLEPTWLAAPPRLARPPRFYEAGEELTGPGAVAAARLYGLEPAHPLLYSRLAPPPPPAAAPGTPHLLSKTPPGALLGAPPPLVPAPRPSSPPRGPGPARADR

SEQ ID NO: 32053 - protein, 980 aa, Homo sapiens
  Payload ID: 6277
  Gene Symbol: FBRS
  Gene Name: fibrosin
  ENSP ID: ENSP00000348489
METAAAAAPGPGWAAEGERRRRRCSRRDRDREQRRRRGPGGDAPRALLAAPRGSSSSSSPPPPARPWSSASSGERPGGPRRRRPRPRPRPPRPRARKRPAGSGSRGEEEEEEEEEGGADDGEAEEEPEEEEEEEEDLIDGFAIASFATLEALQKDASLQPPERLEHRLKHSGKRKRGGSSGATGEPGDSSDREPGRPPGDRARKWPNKRRRKEASSRHSLEAGYICDAESDLDERVSDDDLDPSFTVSTSKASGPHGAFNGNCEAKLSVVPKVSGLERSQEQPPGPDPLLVPFPPKEPPPPPVPRPPVSPPAPLPATPSLPPPPQPQLQLRVSPFGLRTSPYGSSLDLSTGSSSRPPPKAPAPPVAQPPPSSSSSSSSSSSASSSSAQLTHRPPTPSLPLPLSTHSFPPPGLRPPPPPHHPSLFSPGPTLPPPPPLLQVPGHPGASAANALSEQDLIGQDLNSRYLNAQGGPEVVGAGGSARPLAFQFHQHNHQHQHTHQHTHQHFTPYPPGLLPPHGPHMFEKYPGKMEGLFRHNPYTAFPPAVPGLPPGLPPAVSFGSLQGAFQPKSTNPELPPRLGPVPSGLSQKGTQIPDHFRPPLRKPGKWCAMHVRVAYMILRHQEKMKGDSHKLDFRNDLLPCLPGPYGALPPGQELSHPASLFTATGAVHAAANPFTAAPGAHGPFLSPSTHIDPFGRPTSFASLAALSNGAFGGLGSPTFNSGAVFAQKESPGAPPAFASPPDPWGRLHRSPLTFPAWVRPPEAARTPGSDKERPVERREPSITKEEKDRDLPFSRPQLRVSPATPKARAGEEGPRPTKESVRVKEERKEEAAAAAAAAAAAAAAAAAAATGPQGLHLLFERPRPPPFLGPSPPDRCAGFLEPTWLAAPPRLARPPRFYEAGEELTGPGAVAAARLYGLEPAHPLLYSRLAPPPPPAAAPGTPHLLSKTPPGALLGAPPPLVPAPRPSSPPRGPGPARADR

SEQ ID NO: 32054 - protein, 210 aa, Homo sapiens
  Payload ID: 6277
  Gene Symbol: FBRS
  Gene Name: fibrosin
  ENSP ID: ENSP00000456204
  MOD_RES (1)..(1): Any amino acid
XDLIDGFAIASFATLEALQKDASLQPPERLEHRLKHSGKRKRGGSSGATGEPGDSSDREPGRPPGDRARKWPNKRRRKEVSDDDLDPSFTVSTSKASGPHGAFNGNCEAKLSVVPKVSGLERSQEQPPGPDPLLVPFPPKEPPPPPVPRPPVSPPAPLPATPSLPPPPQPQLQLRVSPFGLRTSPYGSSLDLSTGRNQGSGVPCTCVWLT

SEQ ID NO: 32055 - protein, 1045 aa, Homo sapiens
  Payload ID: 6278
  Gene Symbol: FBRSL1
  Gene Name: fibrosin-like 1
  Uniprot ID: Q9HCM7
  ENSP ID: ENSP00000396160
MEAKVRPSRRSRAQRDRGRRREAARDARAQSPSSGDEPEPSPGKENAGLRGAPPRGAAPAPRTARPPRRRRRESSSQEEEVIDGFAIASFSTLEALEKDMALKPHERKEKWERRLIKKPRESETCPPAEPSENRRPLEAGSPGQDLEPACDGARKVPLQPSKQMKVTVSKGGDRDSDDDSVLEATSSRDPLSDSSAHAVSGRGYSCDSESGPDDKASVGSEKLFAPGTDKGPALEKSEAKAGPVPKVSGLERSRELSAESFLPTASPAPHAAPCPGPPPGSRANPLVKKEPPAPHRHTPQPPPPQPRGLLPTHVPASLGAFAGHSQAAANGLHGLSRSSSAPLGLGKHVSLSPHGPGPHLSTSHLALRSQAQHQLHAAMFAAPPTLPPPPALPASSLVLPGHPADHELLRQELNTRFLVQSAERPGASLGPGALLRAEFHQHQHTHQHTHQHTHQHQHTFAPFPAGLPPTPPAAPPPFDKYAPKLDSPYFRHSSVSFFPSFPPAIPGLPTLLPHPGPFGSLQGAFQPKVSDPYRAVVKVSTCWEGPWQGRTLVPPGRPRGARDSRSLQKTWVGVAPAPLSASILSQKPGRWCAVHVQIAWQIYRHQQKIKEMQLDPHKLEVGAKLDLFGRPPAPGVFAGFHYPQDLARPLFPSTGAAHPASNPFGPSAHPGSFLPTGPLTDPFSRPSTFGGLGSLSSHAFGGLGSHALAPGGSIFAPKEGSSVHGLPSPHEAWNRLHRAPPSFPAPPPWPKSVDAERVSALTNHDREPDNGKEEQERDLLEKTRLLSRASPATPAGHPVSGLLLRAQSELGRSGAPAEREAEPRVKESRSPAKEEAAKMPARASPPHSKAAPGDVKVKEERGEDEASEPPAGGLHPAPLQLGLGRERLGAPGFAWEPFRGLELPRRAFPAAAPAPGSAALLEPPERPYRDREPHGYSPERLRGELERARAPHLPPAAPALDGALLPSLGALHFPRLSPAALHNGLLARTPPAAAALGAPPPLVTAAGPPTPPGPPRSRTTPLGGLGPGEARDYSPSRNPPEVEAR

SEQ ID NO: 32056 - protein, 825 aa, Homo sapiens
  Payload ID: 6279
  Gene Symbol: FSCB
  Gene Name: fibrous sheath CABYR binding protein
  Uniprot ID: Q5H9T9
  ENSP ID: ENSP00000344579
MVGKSQQTDVIEKKKHMAIPKSSSPKATHRIGNTSGSKGSYSAKAYESIRVSSELQQTWTKRKHGQEMTSKSLQTDTIVEEKKEVKLVEETVVPEEKSADVREAAIELPESVQDVEIPPNIPSVQLKMDRSQQTSRTGYWTMMNIPPVEKVDKEQQTYFSESEIVVISRPDSSSTKSKEDALKHKSSGKIFASEHPEFQPATNSNEEIGQKNISRTSFTQETKKGPPVLLEDELREEVTVPVVQEGSAVKKVASAEIEPPSTEKFPAKIQPPLVEEATAKAEPRPAEETHVQVQPSTEETPDAEAATAVAENSVKVQPPPAEEAPLVEFPAEIQPPSAEESPSVELLAEILPPSAEESPSEEPPAEILPPPAEKSPSVELLGEIRSPSAQKAPIEVQPLPAEGALEEAPAKVEPPTVEETLADVQPLLPEEAPREEARELQLSTAMETPAEEAPTEFQSPLPKETTAEEASAEIQLLAATEPPADETPAEARSPLSEETSAEEAHAEVQSPLAEETTAEEASAEIQLLAAIEAPADETPAEAQSPLSEETSAEEAPAEVQSPSAKGVSIEEAPLELQPPSGEETTAEEASAAIQLLAATEASAEEAPAEVQPPPAEEAPAEVQPPPAEEAPAEVQPPPAEEAPAEVQPPPAEEAPAEVQPPPAEEAPAEVQPPPAEEAPAEVQSLPAEETPIEETLAAVHSPPADDVPAEEASVDKHSPPADLLLTEEFPIGEASAEVSPPPSEQTPEDEALVENVSTEFQSPQVAGIPAVKLGSVVLEGEAKFEEVSKINSVLKDLSNTNDGQAPTLEIESVFHIELKQRPPEL

SEQ ID NO: 32057 - protein, 581 aa, Homo sapiens
  Payload ID: 6280
  Gene Symbol: FSIP1
  Gene Name: fibrous sheath interacting protein 1
  Uniprot ID: Q8NA03
  ENSP ID: ENSP00000280236
MDIIKGNLDGISKPASNSRIRPGSRSSNASLEVLSTEPGSFKVDTASNLNSGKEDHSESSNTENRRTSNDDKQESCSEKIKLAEEGSDEDLDLVQHQIISECSDEPKLKELDSQLQDAIQKMKKLDKILAKKQRREKEIKKQGLEMRIKLWEEIKSAKYSEAWQSKEEMENTKKFLSLTAVSEETVGPSHEEEDTFSSVFHTQIPPEEYEMQMQKLNKDFTCDVERNESLIKSGKKPFSNTEKIELRGKHNQDFIKRNIELAKESRNPVVMVDREKKRLVELLKDLDEKDSGLSSSEGDQSGWVVPVKGYELAVTQHQQLAEIDIKLQELSAASPTISSFSPRLENRNNQKPDRDGERNMEVTPGEKILRNTKEQRDLHNRLREIDEKLKMMKENVLESTSCLSEEQLKCLLDECILKQKSIIKLSSERKKEDIEDVTPVFPQLSRSIISKLLNESETKVQKTEVEDADMLESEECEASKGYYLTKALTGHNMSEALVTEAENMKCLQFSKDVIISDTKDYFMSKTLGIGRLKRPSFLDDPLYGISVSLSSEDQHLKLSSPENTIADEQETKDAAEECKEP

SEQ ID NO: 32058 - protein, 15 aa, Homo sapiens
  Payload ID: 6280
  Gene Symbol: FSIP1
  Gene Name: fibrous sheath interacting protein 1
  ENSP ID: ENSP00000454177
  MOD_RES (1)..(1): Any amino acid
XEQETKDAAEECKEP

SEQ ID NO: 32059 - protein, 6996 aa, Homo sapiens
  Payload ID: 6281
  Gene Symbol: FSIP2
  Gene Name: fibrous sheath interacting protein 2
  ENSP ID: ENSP00000344403
MKFQLWSSQIRPLGPIFPALRALYALARAAPQEATALLGPLPLEAWNAGGGAEVVGLWPFLVRSGQRDNGVLEKESGAGEEGAEGAVPAMELYLGACSKPAKVAVTKTVASVLAADTQQCRDGVHKTHFAGVGPAQLLDLPLGVKLPVIPGSNAVFYTTNFGEKLFRPSYGFNLTDPYCRLLENQYKSLHDPHLKAYYKRKDILKRLKKGGYITSNNKVVCTLRELNKYRQYLTSLKLDFERNYIKEQRILAKQLHNIPENNQIPQHCDVAQVQNWLLKEGTESIKDQERLMRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHASPKNKKKTSEDIMLVYPAGDQNTYKETHGHTANAAHQRQNSSNNFTKKNSASVVYQADVQDNGINQKRDGMVSKNSSIFDDRGGINISGQGSIISAQVSPTRNFSRVSQAFLDPSKEEKETNADWDGRPTKRSSYLCESGPQAHATDPGIFSSPVYTNMQQNLLQNCLQEKVTSEELNIIIQNVMTWVVATVTSILYPAITKYEKRLQNNTYPVSDDSILSSDSSSFCSTCSEDFTYRSYTSATTKTFQAEPCAFVVDTSVRRPTTPIKPPPAHVEKTVVGKTCHIKGQSIISKHKYNKTNLLYSYPKLRSCKSDSHLLASFETGTKKSKDATTETDSLGSSLHCDKTAKAMDEMKNLKNVFVNFKCYLKGETEVILESILREIMSDLTQAIPSLSSVTAEVFVEQCEREKEILLSNAHIPSVASEIVENMLEKLESAVEKKCVEMFSQDLSVDIKPSLAASDELLTSSNGKPLKNSMPHTLDPMCDIAEDMVHAILEKLMTLVSFKQNEFLHLKDTNKLSCQQHKTDPICMFLQRAGKNKSSLESDEASLIVNEEVQNLISNIFSQSSLVAYIEEAINAILGYIQTELNNERIIASEETVVLLQLLEDILFQLHQEPVNESFQKSRQPRISSPSDTKEKYRLTGTRLSNSPRSGRPFPPINVPGMVLYSDDENEEIDNIVKNVLDSTFKDEKVKSQEQIPNHWFTKGNTCFECKRNIKPPTKPGSRSKAAFHDWELKTEPPSTNHEDILKKKLSSNKDISTFSQDQKHQIEKASENIVTSILKEMLKDISSVPFGHLDSKTGSEASVLVSEKPQGLSHQEWIDQMFSVSEISTVAQEITDSVLNILHKASNYISNTTKSSISSSVHQISLHNSDTEHIVKEAPNKYPLKTWFDSEKKMKYLSLFDVDPEKPPWLKSGKSEPKPVDDINDKIIRTIFKRLKSFICPKLHMGFKSSLRSQLSKYTAKIVNIVLCAIQNELELHKENLNLREIDHTKSLTDKGFFANTDKKLESLVTSIDDDILASPLLTCIYDMLLSSENAHQRSISLSSRKPKSATDSVDVQSILPNRQDKKSFHKYLATPCTHHSVNGGNHIKENAKLQVLERIGETLHEMLSKLLGTHLHSQLSCSQQSREMTNKNQKMAAALQSNIQLISKAILDYILAKLCGVDMDTSFASCGLKAISESLDIDNPSFASIIEKMAKSTKIISSIVSRRVQEDNKEETKSKAKPVAPVSSKTPSTKEMHPNKLKAVASDILNMVFAKLEGFANGHLEILGAINDGNKKSNKIGWEYESTNISRDTHEASFLSALYMHAKKVSSAILKVIQTELNVTSSDLKTSVENPPPETQILKYVVKLILDAVSSDMFNEMESEGGGIETYRYRPTYGSLPGGAESDSFLEDDAYTAKKIIDERSPQREEVKTRSLKQWALEKTLNKIEVKLKEPHISPIAPIIRNILNEIFQSTLINQLNVLSLSHSNFNGMPHNVDEPTPQTSVQFMDKMMDPLLSEADITIVTDNIVRTVFHKLYSAAMTERNVRENRYKTITFSANVSSHEHTYKGKSSVTALDENPCTFQSRFSVADKETKVNLAEDIVQAILTNLETFATSKVKSLFYSQVNFTVPVALPIQQDHSTLSKALSAKDSYSDEQFSCCSVDHTKSGKTNLCQLSLSKLNTYALQVARRNLQGIKQELDKERENPFLTHDIGISESIASQIVNALLDIISRKGKCDKNSSDKEIDLDQQKGVIEKLLNETKYRKVLQLQIQDTIEGILCDIYEKTLFQNNLSFATPTLKCSIADKHSEENSEMFMEGANKIIPKLSVPKSDVILISNDIVNIVLHNLSSAATLVINAKNPTSARLPLTFCDTFPKIDCQQPLKGSKTERKTERFSYSRNQKSAYADDNQITVVEKEDTQKSATDSCEENANFITKTIFKRLESFATERIDSLITLAFQSKEKSFVIPELENCKQNDSIFYDSSQVESDVNVLKISATETILSQELTDFTFVGRREKLGSTIHLSQARLKTYADVIASAILKLIKNDLDLEIQKIYPYQNNILFQENIIVSEIVDSMLKMLDDKRSVKEICFNSKENSNFSQLALSNEILLGHKEKERSTKQSLFTKYPLEQNQMILENKRQIIVLEEIFMRNGESKNKEKGELLIAVEELLNKLYQRVREVTGHLPPLNETANFISNSKIKTSDTTQKNSFQSHINSVANDIVESVLGKMYLVVVTSLYENNKSRTEVEISDHNDSLLMKPLRFRETKQAGKISNSPRYAISQAYSYVDSQNISVMENTLLPYLPLQVKKDLIQMVLNKITNFVSLPLKVSPKDNPKPCFKAHLKTRSKITTLPKFTKKTHLGLSAAKAKSKTKLGPGEKTLKDSRSKTAIGLSHIMSAGDAKNLLDTKLPTSELKIYAKDIIINILETIVKEFGKVKQTKALPSDQIIAAGKIVNTVLQELYVTNNCNLAYPMKSSHLRLSQGNIGTGSLPKQQACFYLENVSSQLEHIFPREGIFKKLFDKWQTESNDKENEKCKLLMIAENVLTEISIKAKELEYSLSLLNLPPLENCESRFYNHFKGASTRAEDTKAQINMFGREIVEMLLEKLQLCFLSQIPTPDSEETLSNSKEHITAKSKYGFPNKHSLSSLPIYNTKTKDQISVGSSNQIVQEIVETVLNMLESFVDLQFKHISKYEFSEIVKMPIENLSSIQQKLLNKKMLPKLQPLKMFSDKSESNTINFKENIQNILLRVHSFHSQLLTYAVNIISDMLAVIKNKLDNEISQMEPSSISILKENIVASEIIGTLMDQCTYFNESLIQNLSRESLFQGAENAYTVNQVELATNMKMFTSKLKEGSLGINPSQVSKTGFVFCSDEDMKEKYRVSSDLPTSVRSSVEDTVKNSEPTKRPDSETMPSCSTRNKVQDHRPRESNFGSFDQTMKGNSYLPEGSFLQKLLRKASDSTEAALKQVLSFIEMGKGENLRVFHYENLKPVVEPNQIQTTISPLKICLAAENIVNTVLSSCGFPSQPHTNENREIMKPFFISKQSSLSEVSGGQKDNEKSLLRMQDKKINYIPEEENENLEASREDSSFLQKLKKKEYPKIETVKEVEAFTFADHEMGSNEVHLIARHVTTSVVTYLKNFETTVFSEEKMSVSTWSRKKYESKQFLRNIYDDSSIYQCCEHLTESVLYHLTSSISDGTKKGREKEKAWEIQEATFSKIISIHSQVFESRSISIGELALCISEIIIKILFNNKIIQADIAQKMVAIPTKYTYCPGIVSGGFDDLFQDLLVGVIHVLSKEIEVDYHFESNVRNKSFSMHRNNSVPLCNKINRQASPRDWQFSTQQIGQLFQKNKLSYLACKLNSLVGNLKTSESKEVVNKVFNIVSDLFSPDECLDTGMDSGKIQRTYFYSSNNEQPNSILTNNLQLSSKSVFLLNVVCEKLIRILLEECTSTAFPDKGSVSEETSAEECQLLKMLQSVEDGKSDYRKGGMDCECLQVDYMSDLLENVAEIDQDLLTSDSMLTIISHSLVKSLMDKLSHSIQQAPESLPFANKHLNYRTREIQSSFIKARKSELIELGQSKSSLELRSYDSNSLTVSLNNPSVVSSKIQAPFNKHCAVKSSSVSPFERQRTKEMDKVAIHNKLHQEGIYAGVYSATFLEGIISELFFNLSMSLWGKNKNITVSWLNEMNTLFVNNVVNEFNNAQVTVLRNAEERLCFPPVHTETVSKIVDSVYYDVLQQYELKVACGNNPVYDNASIAEQITNGILLEILDYKLPSCFKEHLIPHSYYPLKPEIILQKLQSNLTEFTSLPRSSSDYSTMLSHSFLEDVIRRLLSQLIPPPITCSSLGKKYLMSSDFNEMSTCIINKVMSAISKHKIWFTIYDNQYLYTGKNLQKMVDSVYCNILQMSDSLVSIQKSIVSRSPIMIDQIASFIIQEIIENHLQPFLSGEVLCHPRTPLDPVSTIVTQVLSEVIESHRPQKQSPLDIHLDSFVREIVARLLSKIFSPKHNTEIELKNMTQRIVNSINRHFNKAKIHILYDDKEQAFFSFNTDIVDELATSVYRNALKQHGLDLAVDKESEDSGIFVENITNLIVAAISDYLLHPLFSGDFSASTYSNSVAENIVQDILSNISKSTEPSQSVPLYNTLLPYTFLEDMIRVLLSKLFSSASSLVLNRDTQKDISRVNFNDIASNLVSDIRMKVSQHEIRFSKEEEETKFIYSEDDIQHLVDSVFANVVQTSGSQESAVQNITSSNDILIDRIAGFIIKHICQKHLQPFVSGKSLSSSDTYFDDERRQLFYTSVYSSTFLEDVISGVLRKIFHRVVGIVQTKSIRDSEDELFEKAEELIHLITGEFSKAQVSIIDNTEERLCLPPVERDVVKTIVDMVYSKVLQEYEMEVVPNKDFLNDTKTLAARITNIILAEIFDFQIHPDLIANLPFKSHSKLSANVLIQRVQYDISKSRFQRQASTMYTTMLSHSHLEKIVTQLTSQISPLNTSAEQSDTTKSDLSNTVIKLINEIMSIISKHEICIIKYGNKKQSMISAKDIQSMVDSIYADLSHSNIYQSITKDKKSISDIPVSKIASFIIKEIFNHHIQSFLSEDKTLLLAAVDQTYKLKAIDPKQRELSFIVNSSVFLEEVISELLCKILYAFSHNMLVTENPDRVKLKLTRIVTTLVNSIVLEFTTSEILVADNFDKNLCFSERYKEMVQKIVNSVYGKVLDQYKSLIQIHRVIQSDTICFGRKIYYLLLEEIYDYQVQSLVSGELESSSYSYPQADNIIRNVLNIITKDSHALPPYITVLPHSLLEDMVYRLLGHVFPSTHTENELKEKKFPPDDEFVEAASKLTDEIIKEISEHEIRLSMAEDNAESMQLEPIENLVDSICNNILKTSEFQAEVQKDADKKGCSFLSKLAGFIMKEIMYHHLQPFLHGEESSFSDLSDYDHVSELAKSGKEKTQPSLYSATFLEDIIIDLVHKFCSLLIITEDSKKNEMAELDIMGLALKLANSLIREFKKSDIKVLPNAEKMFSFPPIDKETVDKISNFVYEQFIEKCTSHDIQKGDESNIAIGMIAALTQKAISAFRIQPLFSGDWSSTFFSFLNPDNITQRVQHLPQNTFTQISRCAKENQLSLPDQSYKDTSSTPDCKNMMSTLEINRGTMNRKKSFKTKDTSVKKGDIQNPVLSSINAIMKSGMINLTSGLATGVTNKKEVDENKVGICTQKHSENVSKVTSTTTVKSKDTQEPNLSETFNNNEIEKKRNLIPTDKKGKDDEIYTHFSLIIDDTEYEKEVLGSDSEIGYKKKIDNARESSFKKDDKLFQLSSLKSKRNLGTTTDTLEIRIRTSSNEGRRDSPTQTCRDEEHHSDYEHVQNVIENIFEDVLELSSSPEPAYYSKLSYDQSPPGDNVLNVIQEISRDSAQSVTTKKVSSSTNKNISAKEKEEEEREKEKVREEIKSEPSKPDDPQNQRESKPGIFPAKFLEDVITEMVKQLIFSSIPETQIQDRCQNVSDKQNQAKLYDTAMKLINSLLKEFSDAQIKVFRPDKGNQFPGGKVSSVPKVPPRYKEPTTDEAPSSIKIKSADKMPPMHKMMRKPSSDKIPSIDKTLVNKVVHSSVCNILNDYGSQDSIWKNINSNGENLARRLTSAVINEIFQRQVNLIFCDEVSVSACLPLESKDVVKKVQKLAQTASKECQTSSPYTIILPHKFLENVISALFSKIFSTISSTKTKEPEDNLSTELNFLQMKLVSAVATEISQDKYMTIQYVETLQSDDDEIIQLVVQSVYNNLLPQFGSQEIIQNCVTSGCKILSENIVDLVLREVASNQLQSYFCGELTPHQCVEVENIVEKILKDVFQTTDVPLPKPSHADKLSYNIIEEIAVKFLSKLLSIFPKVHKERTKSLETDMQKITSKVLNSVQEFISKSKIKLVPPTKESPTVPVADNATIENIVNSIYTSVLKHSGSYTSVFKDLMGKSNVLSDTIGFLMVNAISNSEFQPQVEEEVSNSELVLEAVKIMEKVIKIIDELKSKEKSSSRKGLTLDAKLLEEVLALFLAKLIRLPSSSSKDEKNLSKTELNKIASQLSKLVTAEISRSSISLIASDPEEHCLNPENTERIYQVVDSVYSNILQQSGTNKEFYYDIKDTNTAFPKKVASLIIDGVSSFPLDTINSTISNADLSGELDVNRIVQKAQEHAFNVIPELEQEKLDQNLSEEESPIKIVPHVGKKPVKIDPKIISEHLAVISIKTQPLEKLKQECLKRTGHSIAELRRASISGRNYSLGSPDLEKRKTERRTSLDKTGRLDVKPLEAVARNSFQNIRKPDITKVELLKDVQSKNDLIVRLVAHDIDQVYLENYIKEERDSDEDEVVLTQTFAKEEGIKVFEDQVKEVKKPIQSKLSPKSTLSTSSLKKFLSLSKCCQTTASANIESTEAISNQVIESKETHVKRAVAELDMATPKTMPETASSSWEEKPQCKKEEKNLVTEPTHYFIHRIMSSSSYNQEDLISSTGEAEDCHSDPSAKILEESSQEQKPEHGNSVKFITIFERSKDVLGSANPSKEVISETPKPDVSKQGSKMLTKMSSTLSKVFSQCNTNISRSSSPAHQDEH

SEQ ID NO: 32060 - protein, 973 aa, Homo sapiens
  Payload ID: 6281
  Gene Symbol: FSIP2
  Gene Name: fibrous sheath interacting protein 2
  ENSP ID: ENSP00000390251
  MOD_RES (1)..(1): Any amino acid
XYQRVREVTGHLPPLNETANFISNSKIKTSDTTQKNSFQSHINSVANDIVESVLGKMYLVVVTSLYENNKSRTEVEISDHNDSLLMKPLRFRETKQAGKISNSPRYAISQAYSYVDSQNISVMENTLLPYLPLQVKKDLIQMVLNKITNFVSLPLKVSPKDNPKPCFKAHLKTRSKITTLPKFTKKTHLGLSAAKAKSKTKLGPGEKTLKDSRSKTAIGLSHIMSAGDAKNLLDTKLPTSELKIYAKDIIINILETIVKEFGKVKQTKALPSDQIIAAGKIVNTVLQELYVTNNCNLAYPMKSSHLRLSQGNIGTGSLPKQQACFYLENVSSQLEHIFPREGIFKKLFDKWQTESNDKENEKCKLLMIAENVLTEISIKAKELEYSLSLLNLPPLENCESRFYNHFKGASTRAEDTKAQINMFGREIVEMLLEKLQLCFLSQIPTPDSEETLSNSKEHITAKSKYGFPNKHSLSSLPIYNTKTKDQISVGSSNQIVQEIVETVLNMLESFVDLQFKHISKYEFSEIVKMPIENLSSIQQKLLNKKMLPKLQPLKMFSDKSESNTINFKENIQNILLRVHSFHSQLLTYAVNIISDMLAVIKNKLDNEISQMEPSSISILKENIVASEIIGTLMDQCTYFNESLIQNLSRESLFQGAENAYTVNQVELATNMKMFTSKLKEGSLGINPSQVSKTGFVFCSDEDMKEKYRVSSDLPTSVRSSVEDTVKNSEPTKRPDSETMPSCSTRNKVQDHRPRESNFGSFDQTMKGNSYLPEGSFLQKLLRKASDSTEAALKQVLSFIEMGKGENLRVFHYENLKPVVEPNQIQTTISPLKICLAAENIVNTVLSSCGFPSQPHTNENREIMKPFFISKQSSLSEVSGGQKDNEKSLLRMQDKKINYIPEEENENLEASREDSSFLQKLKKKEYPKIETVKEVEAFTFADHEMGSNEVHLIARHVTTSVVTYLKNFETTGRC

SEQ ID NO: 32061 - protein, 136 aa, Homo sapiens
  Payload ID: 6281
  Gene Symbol: FSIP2
  Gene Name: fibrous sheath interacting protein 2
  ENSP ID: ENSP00000395888
KDQERLMRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHGE

SEQ ID NO: 32062 - protein, 6907 aa, Homo sapiens
  Payload ID: 6281
  Gene Symbol: FSIP2
  Gene Name: fibrous sheath interacting protein 2
  Uniprot ID: Q5CZC0
  ENSP ID: ENSP00000401306
MELYLGACSKPAKVAVTKTVASVLAADTQQCRDGVHKTHFAGVGPAQLLDLPLGVKLPVIPGSNAVFYTTNFGEKLFRPSYGFNLTDPYCRLLENQYKSLHDPHLKAYYKRKDILKRLKKGGYITSNNKVVCTLRELNKYRQYLTSLKLDFERNYIKEQRILAKQLHNIPENNQIPQHCDVAQVQNWLLKEGTESIKDQERLMRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHASPKNKKKTSEDIMLVYPAGDQNTYKETHGHTANAAHQRQNSSNNFTKKNSASVVYQADVQDNGINQKRDGMVSKNSSIFDDRGGINISGQGSIISAQVSPTRNFSRVSQAFLDPSKEEKETNADWDGRPTKRSSYLCESGPQAHATDPGIFSSPVYTNMQQNLLQNCLQEKVTSEELNIIIQNVMTWVVATVTSILYPAITKYEKRLQNNTYPVSDDSILSSDSSSFCSTCSEDFTYRSYTSATTKTFQAEPCAFVVDTSVRRPTTPIKPPPAHVEKTVVGKTCHIKGQSIISKHKYNKTNLLYSYPKLRSCKSDSHLLASFETGTKKSKDATTETDSLGSSLHCDKTAKAMDEMKNLKNVFVNFKCYLKGETEVILESILREIMSDLTQAIPSLSSVTAEVFVEQCEREKEILLSNAHIPSVASEIVENMLEKLESAVEKKCVEMFSQDLSVDIKPSLAASDELLTSSNGKPLKNSMPHTLDPMCDIAEDMVHAILEKLMTLVSFKQNEFLHLKDTNKLSCQQHKTDPICMFLQRAGKNKSSLESDEASLIVNEEVQNLISNIFSQSSLVAYIEEAINAILGYIQTELNNERIIASEETVVLLQLLEDILFQLHQEPVNESFQKSRQPRISSPSDTKEKYRLTGTRLSNSPRSGRPFPPINVPGMVLYSDDENEEIDNIVKNVLDSTFKDEKVKSQEQIPNHWFTKGNTCFECKRNIKPPTKPGSRSKAAFHDWELKTEPPSTNHEDILKKKLSSNKDISTFSQDQKHQIEKASENIVTSILKEMLKDISSVPFGHLDSKTGSEASVLVSEKPQGLSHQEWIDQMFSVSEISTVAQEITDSVLNILHKASNYISNTTKSSISSSVHQISLHNSDTEHIVKEAPNKYPLKTWFDSEKKMKYLSLFDVDPEKPPWLKSGKSEPKPVDDINDKIIRTIFKRLKSFICPKLHMGFKSSLRSQLSKYTAKIVNIVLCAIQNELELHKENLNLREIDHTKSLTDKGFFANTDKKLESLVTSIDDDILASPLLTCIYDMLLSSENAHQRSISLSSRKPKSATDSVDVQSILPNRQDKKSFHKYLATPCTHHSVNGGNHIKENAKLQVLERIGETLHEMLSKLLGTHLHSQLSCSQQSREMTNKNQKMAAALQSNIQLISKAILDYILAKLCGVDMDTSFASCGLKAISESLDIDNPSFASIIEKMAKSTKIISSIVSRRVQEDNKEETKSKAKPVAPVSSKTPSTKEMHPNKLKAVASDILNMVFAKLEGFANGHLEILGAINDGNKKSNKIGWEYESTNISRDTHEASFLSALYMHAKKVSSAILKVIQTELNVTSSDLKTSVENPPPETQILKYVVKLILDAVSSDMFNEMESEGGGIETYRYRPTYGSLPGGAESDSFLEDDAYTAKKIIDERSPQREEVKTRSLKQWALEKTLNKIEVKLKEPHISPIAPIIRNILNEIFQSTLINQLNVLSLSHSNFNGMPHNVDEPTPQTSVQFMDKMMDPLLSEADITIVTDNIVRTVFHKLYSAAMTERNVRENRYKTITFSANVSSHEHTYKGKSSVTALDENPCTFQSRFSVADKETKVNLAEDIVQAILTNLETFATSKVKSLFYSQVNFTVPVALPIQQDHSTLSKALSAKDSYSDEQFSCCSVDHTKSGKTNLCQLSLSKLNTYALQVARRNLQGIKQELDKERENPFLTHDIGISESIASQIVNALLDIISRKGKCDKNSSDKEIDLDQQKGVIEKLLNETKYRKVLQLQIQDTIEGILCDIYEKTLFQNNLSFATPTLKCSIADKHSEENSEMFMEGANKIIPKLSVPKSDVILISNDIVNIVLHNLSSAATLVINAKNPTSARLPLTFCDTFPKIDCQQPLKGSKTERKTERFSYSRNQKSAYADDNQITVVEKEDTQKSATDSCEENANFITKTIFKRLESFATERIDSLITLAFQSKEKSFVIPELENCKQNDSIFYDSSQVESDVNVLKISATETILSQELTDFTFVGRREKLGSTIHLSQARLKTYADVIASAILKLIKNDLDLEIQKIYPYQNNILFQENIIVSEIVDSMLKMLDDKRSVKEICFNSKENSNFSQLALSNEILLGHKEKERSTKQSLFTKYPLEQNQMILENKRQIIVLEEIFMRNGESKNKEKGELLIAVEELLNKLYQRVREVTGHLPPLNETANFISNSKIKTSDTTQKNSFQSHINSVANDIVESVLGKMYLVVVTSLYENNKSRTEVEISDHNDSLLMKPLRFRETKQAGKISNSPRYAISQAYSYVDSQNISVMENTLLPYLPLQVKKDLIQMVLNKITNFVSLPLKVSPKDNPKPCFKAHLKTRSKITTLPKFTKKTHLGLSAAKAKSKTKLGPGEKTLKDSRSKTAIGLSHIMSAGDAKNLLDTKLPTSELKIYAKDIIINILETIVKEFGKVKQTKALPSDQIIAAGKIVNTVLQELYVTNNCNLAYPMKSSHLRLSQGNIGTGSLPKQQACFYLENVSSQLEHIFPREGIFKKLFDKWQTESNDKENEKCKLLMIAENVLTEISIKAKELEYSLSLLNLPPLENCESRFYNHFKGASTRAEDTKAQINMFGREIVEMLLEKLQLCFLSQIPTPDSEETLSNSKEHITAKSKYGFPNKHSLSSLPIYNTKTKDQISVGSSNQIVQEIVETVLNMLESFVDLQFKHISKYEFSEIVKMPIENLSSIQQKLLNKKMLPKLQPLKMFSDKSESNTINFKENIQNILLRVHSFHSQLLTYAVNIISDMLAVIKNKLDNEISQMEPSSISILKENIVASEIIGTLMDQCTYFNESLIQNLSRESLFQGAENAYTVNQVELATNMKMFTSKLKEGSLGINPSQVSKTGFVFCSDEDMKEKYRVSSDLPTSVRSSVEDTVKNSEPTKRPDSETMPSCSTRNKVQDHRPRESNFGSFDQTMKGNSYLPEGSFLQKLLRKASDSTEAALKQVLSFIEMGKGENLRVFHYENLKPVVEPNQIQTTISPLKICLAAENIVNTVLSSCGFPSQPHTNENREIMKPFFISKQSSLSEVSGGQKDNEKSLLRMQDKKINYIPEEENENLEASREDSSFLQKLKKKEYPKIETVKEVEAFTFADHEMGSNEVHLIARHVTTSVVTYLKNFETTVFSEEKMSVSTWSRKKYESKQFLRNIYDDSSIYQCCEHLTESVLYHLTSSISDGTKKGREKEKAWEIQEATFSKIISIHSQVFESRSISIGELALCISEIIIKILFNNKIIQADIAQKMVAIPTKYTYCPGIVSGGFDDLFQDLLVGVIHVLSKEIEVDYHFESNVRNKSFSMHRNNSVPLCNKINRQASPRDWQFSTQQIGQLFQKNKLSYLACKLNSLVGNLKTSESKEVVNKVFNIVSDLFSPDECLDTGMDSGKIQRTYFYSSNNEQPNSILTNNLQLSSKSVFLLNVVCEKLIRILLEECTSTAFPDKGSVSEETSAEECQLLKMLQSVEDGKSDYRKGGMDCECLQVDYMSDLLENVAEIDQDLLTSDSMLTIISHSLVKSLMDKLSHSIQQAPESLPFANKHLNYRTREIQSSFIKARKSELIELGQSKSSLELRSYDSNSLTVSLNNPSVVSSKIQAPFNKHCAVKSSSVSPFERQRTKEMDKVAIHNKLHQEGIYAGVYSATFLEGIISELFFNLSMSLWGKNKNITVSWLNEMNTLFVNNVVNEFNNAQVTVLRNAEERLCFPPVHTETVSKIVDSVYYDVLQQYELKVACGNNPVYDNASIAEQITNGILLEILDYKLPSCFKEHLIPHSYYPLKPEIILQKLQSNLTEFTSLPRSSSDYSTMLSHSFLEDVIRRLLSQLIPPPITCSSLGKKYLMSSDFNEMSTCIINKVMSAISKHKIWFTIYDNQYLYTGKNLQKMVDSVYCNILQMSDSLVSIQKSIVSRSPIMIDQIASFIIQEIIENHLQPFLSGEVLCHPRTPLDPVSTIVTQVLSEVIESHRPQKQSPLDIHLDSFVREIVARLLSKIFSPKHNTEIELKNMTQRIVNSINRHFNKAKIHILYDDKEQAFFSFNTDIVDELATSVYRNALKQHGLDLAVDKESEDSGIFVENITNLIVAAISDYLLHPLFSGDFSASTYSNSVAENIVQDILSNISKSTEPSQSVPLYNTLLPYTFLEDMIRVLLSKLFSSASSLVLNRDTQKDISRVNFNDIASNLVSDIRMKVSQHEIRFSKEEEETKFIYSEDDIQHLVDSVFANVVQTSGSQESAVQNITSSNDILIDRIAGFIIKHICQKHLQPFVSGKSLSSSDTYFDDERRQLFYTSVYSSTFLEDVISGVLRKIFHRVVGIVQTKSIRDSEDELFEKAEELIHLITGEFSKAQVSIIDNTEERLCLPPVERDVVKTIVDMVYSKVLQEYEMEVVPNKDFLNDTKTLAARITNIILAEIFDFQIHPDLIANLPFKSHSKLSANVLIQRVQYDISKSRFQRQASTMYTTMLSHSHLEKIVTQLTSQISPLNTSAEQSDTTKSDLSNTVIKLINEIMSIISKHEICIIKYGNKKQSMISAKDIQSMVDSIYADLSHSNIYQSITKDKKSISDIPVSKIASFIIKEIFNHHIQSFLSEDKTLLLAAVDQTYKLKAIDPKQRELSFIVNSSVFLEEVISELLCKILYAFSHNMLVTENPDRVKLKLTRIVTTLVNSIVLEFTTSEILVADNFDKNLCFSERYKEMVQKIVNSVYGKVLDQYKSLIQIHRVIQSDTICFGRKIYYLLLEEIYDYQVQSLVSGELESSSYSYPQADNIIRNVLNIITKDSHALPPYITVLPHSLLEDMVYRLLGHVFPSTHTENELKEKKFPPDDEFVEAASKLTDEIIKEISEHEIRLSMAEDNAESMQLEPIENLVDSICNNILKTSEFQAEVQKDADKKGCSFLSKLAGFIMKEIMYHHLQPFLHGEESSFSDLSDYDHVSELAKSGKEKTQPSLYSATFLEDIIIDLVHKFCSLLIITEDSKKNEMAELDIMGLALKLANSLIREFKKSDIKVLPNAEKMFSFPPIDKETVDKISNFVYEQFIEKCTSHDIQKGDESNIAIGMIAALTQKAISAFRIQPLFSGDWSSTFFSFLNPDNITQRVQHLPQNTFTQISRCAKENQLSLPDQSYKDTSSTPDCKNMMSTLEINRGTMNRKKSFKTKDTSVKKGDIQNPVLSSINAIMKSGMINLTSGLATGVTNKKEVDENKVGICTQKHSENVSKVTSTTTVKSKDTQEPNLSETFNNNEIEKKRNLIPTDKKGKDDEIYTHFSLIIDDTEYEKEVLGSDSEIGYKKKIDNARESSFKKDDKLFQLSSLKSKRNLGTTTDTLEIRIRTSSNEGRRDSPTQTCRDEEHHSDYEHVQNVIENIFEDVLELSSSPEPAYYSKLSYDQSPPGDNVLNVIQEISRDSAQSVTTKKVSSSTNKNISAKEKEEEEREKEKVREEIKSEPSKPDDPQNQRESKPGIFPAKFLEDVITEMVKQLIFSSIPETQIQDRCQNVSDKQNQAKLYDTAMKLINSLLKEFSDAQIKVFRPDKGNQFPGGKVSSVPKVPPRYKEPTTDEAPSSIKIKSADKMPPMHKMMRKPSSDKIPSIDKTLVNKVVHSSVCNILNDYGSQDSIWKNINSNGENLARRLTSAVINEIFQRQVNLIFCDEVSVSACLPLESKDVVKKVQKLAQTASKECQTSSPYTIILPHKFLENVISALFSKIFSTISSTKTKEPEDNLSTELNFLQMKLVSAVATEISQDKYMTIQYVETLQSDDDEIIQLVVQSVYNNLLPQFGSQEIIQNCVTSGCKILSENIVDLVLREVASNQLQSYFCGELTPHQCVEVENIVEKILKDVFQTTDVPLPKPSHADKLSYNIIEEIAVKFLSKLLSIFPKVHKERTKSLETDMQKITSKVLNSVQEFISKSKIKLVPPTKESPTVPVADNATIENIVNSIYTSVLKHSGSYTSVFKDLMGKSNVLSDTIGFLMVNAISNSEFQPQVEEEVSNSELVLEAVKIMEKVIKIIDELKSKEKSSSRKGLTLDAKLLEEVLALFLAKLIRLPSSSSKDEKNLSKTELNKIASQLSKLVTAEISRSSISLIASDPEEHCLNPENTERIYQVVDSVYSNILQQSGTNKEFYYDIKDTNTAFPKKVASLIIDGVSSFPLDTINSTISNADLSGELDVNRIVQKAQEHAFNVIPELEQEKLDQNLSEEESPIKIVPHVGKKPVKIDPKIISEHLAVISIKTQPLEKLKQECLKRTGHSIAELRRASISGRNYSLGSPDLEKRKTERRTSLDKTGRLDVKPLEAVARNSFQNIRKPDITKVELLKDVQSKNDLIVRLVAHDIDQVYLENYIKEERDSDEDEVVLTQTFAKEEGIKVFEDQVKEVKKPIQSKLSPKSTLSTSSLKKFLSLSKCCQTTASANIESTEAISNQVIESKETHVKRAVAELDMATPKTMPETASSSWEEKPQCKKEEKNLVTEPTHYFIHRIMSSSSYNQEDLISSTGEAEDCHSDPSAKILEESSQEQKPEHGNSVKFITIFERSKDVLGSANPSKEVISETPKPDVSKQGSKMLTKMSSTLSKVFSQCNTNISRSSSPAHQDEH

SEQ ID NO: 32063 - protein, 646 aa, Homo sapiens
  Payload ID: 6281
  Gene Symbol: FSIP2
  Gene Name: fibrous sheath interacting protein 2
  ENSP ID: ENSP00000478995
MVKQLIFSSIPETQIQDRCQNVSDKQNQAKLYDTAMKLINSLLKEFSDAQIKVFRPDKGNQFPGGKVSSVPKVPPRYKEPTTDEAPSSIKIKSADKMPPMHKMMRKPSSDKIPSIDKTLVNKVVHSSVCNILNDYGSQDSIWKNINSNGENLARRLTSAVINEIFQRQVNLIFCDEVSVSACLPLESKDVVKKVQKLAQTASKECQTSSPYTIILPHKFLENVISALFSKIFSTISSTKTKEPEDNLSTELNFLQMKLVSAVATEISQDKYMTIQYVETLQSDDDEIIQLVVQSVYNNLLPQFGSQEIIQNCVTSGCKILSENIVDLVLPKPSHADKLSYNIIEEIAVKFLSKLLSIFPKVHKERTKSLETDMQKITSKVLNSVQEFISKSKIKLVPPTKESPTVPVADNATIENIVNSIYTSVLKHSGSYTSVFKDLMGKSNVLSDTIGFLMVNAISNSEFQPQVEEEVSNSELVLEAVKIMEKVIKIIDELKSKEKSSSRKGLTLDAKLLEEVLALFLAKLIRLPSSSSKDEKNLSKTELNKIASQLSKLVTAEISRSSISLIASDPEEHCLNPENTERIYQVVDSVYSNILQQSGTNKEFYYDIKDTNTAFPKKVASLIIDGVSSFPLIQLTQQFQMLISLES

SEQ ID NO: 32064 - protein, 683 aa, Homo sapiens
  Payload ID: 6282
  Gene Symbol: FBLN1
  Gene Name: fibulin 1
  Uniprot ID: P23142
  ENSP ID: ENSP00000262722
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATRCERLPCHENRECSKLPLRITYYHLSFPTNIQAPAVVFRMGPSSAVPGDSMQLAITGGNEEGFFTTRKVSPHSGVVALTKPVPEPRDLLLTVKMDLSRHGTVSSFVAKLFIFVSAEL

SEQ ID NO: 32065 - protein, 703 aa, Homo sapiens
  Payload ID: 6282
  Gene Symbol: FBLN1
  Gene Name: fibulin 1
  Uniprot ID: P23142
  ENSP ID: ENSP00000331544
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATLQQEKTDTVRCIKSCRPNDVTCVFDPVHTISHTVISLPTFREFTRPEEIIFLRAITPPHPASQANIIFDITEGNLRDSFDIIKRYMDGMTVGVVRQVRPIVGPFHAVLKLEMNYVVGGVVSHRNVVNVHIFVSEYWF

SEQ ID NO: 32066 - protein, 566 aa, Homo sapiens
  Payload ID: 6282
  Gene Symbol: FBLN1
  Gene Name: fibulin 1
  Uniprot ID: P23142
  ENSP ID: ENSP00000342212
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAAT

SEQ ID NO: 32067 - protein, 721 aa, Homo sapiens
  Payload ID: 6282
  Gene Symbol: FBLN1
  Gene Name: fibulin 1
  ENSP ID: ENSP00000385521
MERAAPSRRVPLPLLLLGGLALLAAGVDADVLLEACCADGHRMATHQKDCSLPYATESKECRAVGLASLCQDLNGAWAVWKVGRASQAEGTASARAQRRGMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATRCERLPCHENRECSKLPLRITYYHLSFPTNIQAPAVVFRMGPSSAVPGDSMQLAITGGNEEGFFTTRKVSPHSGVVALTKPVPEPRDLLLTVKMDLSRHGTVSSFVAKLFIFVSAEL

SEQ ID NO: 32068 - protein, 601 aa, Homo sapiens
  Payload ID: 6282
  Gene Symbol: FBLN1
  Gene Name: fibulin 1
  Uniprot ID: P23142
  ENSP ID: ENSP00000393812
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATQKSKKGRQNTPAGSSKEDCRVLPWKQGLEDTHLDA

SEQ ID NO: 32069 - protein, 92 aa, Homo sapiens
  Payload ID: 6282
  Gene Symbol: FBLN1
  Gene Name: fibulin 1
  ENSP ID: ENSP00000395329
ALLAAGGRGVPGPPPQLRVPTPSASRSLRVSEPRGLGVRALPCAAPPDCQRRGLGDAPLPHGQLRSSSPPRPGDLFQNRIPPPLKHTVLPQS

SEQ ID NO: 32070 - protein, 183 aa, Homo sapiens
  Payload ID: 6282
  Gene Symbol: FBLN1
  Gene Name: fibulin 1
  ENSP ID: ENSP00000401077
  MOD_RES (1)..(1): Any amino acid
XKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKEYSGILPLPTQATVQEWLYTRCSRQLY

SEQ ID NO: 32071 - protein, 172 aa, Homo sapiens
  Payload ID: 6282
  Gene Symbol: FBLN1
  Gene Name: fibulin 1
  ENSP ID: ENSP00000402963
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETGGGPCKQQCRD

SEQ ID NO: 32072 - protein, 65 aa, Homo sapiens
  Payload ID: 6282
  Gene Symbol: FBLN1
  Gene Name: fibulin 1
  ENSP ID: ENSP00000404024
MATHQKDCSLPYATESKECRMVQEQCCHSQLEELHCATGISLANEQDRCATPHGDNASLEATFVK

SEQ ID NO: 32073 - protein, 139 aa, Homo sapiens
  Payload ID: 6282
  Gene Symbol: FBLN1
  Gene Name: fibulin 1
  ENSP ID: ENSP00000414584
MATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCR

SEQ ID NO: 32074 - protein, 181 aa, Homo sapiens
  Payload ID: 6282
  Gene Symbol: FBLN1
  Gene Name: fibulin 1
  ENSP ID: ENSP00000415160
CRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETGGGPCKQQCRDTGDEVVCSCFVGYQLLSDGVSCEDVNECITGSHSCRLGESCINTVGSFRCQRDSSCGTGYELTEDNSCK

SEQ ID NO: 32075 - protein, 189 aa, Homo sapiens
  Payload ID: 6282
  Gene Symbol: FBLN1
  Gene Name: fibulin 1
  ENSP ID: ENSP00000415289
MNSYTRGSRRPSAKAASPAASVTSRVSPSGPGVPVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCR

SEQ ID NO: 32076 - protein, 60 aa, Homo sapiens
  Payload ID: 6282
  Gene Symbol: FBLN1
  Gene Name: fibulin 1
  ENSP ID: ENSP00000489422
DITEGNLRDSFDIIKRYMDGMTVAPLLNCHILKDLQSWEMKTVASAILDSDLYSEHFQSS

SEQ ID NO: 32077 - protein, 1184 aa, Homo sapiens
  Payload ID: 6283
  Gene Symbol: FBLN2
  Gene Name: fibulin 2
  Uniprot ID: P98095
  ENSP ID: ENSP00000295760
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 32078 - protein, 109 aa, Homo sapiens
  Payload ID: 6283
  Gene Symbol: FBLN2
  Gene Name: fibulin 2
  ENSP ID: ENSP00000295761
  MOD_RES (1)..(1): Any amino acid
XIDECAQGAGILCTFRCLNVPGSYQCACPEQGYTMTANGRSCKDVDECALGTHNCSEAETCHNIQGSFRCLRFECPPNYVQVSKTWCVPTQAPSGSLHGGPRPWRVPCG

SEQ ID NO: 32079 - protein, 1231 aa, Homo sapiens
  Payload ID: 6283
  Gene Symbol: FBLN2
  Gene Name: fibulin 2
  Uniprot ID: P98095
  ENSP ID: ENSP00000384169
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDQDECLMGAHDCSRRQFCVNTLGSFYCVNHTVLCADGYILNAHRKCVDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 32080 - protein, 101 aa, Homo sapiens
  Payload ID: 6283
  Gene Symbol: FBLN2
  Gene Name: fibulin 2
  ENSP ID: ENSP00000399224
  MOD_RES (1)..(1): Any amino acid
XVDECALGTHNCSEAETCHNIQGSFRCLRFECPPNYVQVSKTKCERTKWKLARWATAVAGALWVRLGDDLRTRDTRPCWGSWTPLDDPSPKLTFHFMFHCD

SEQ ID NO: 32081 - protein, 1231 aa, Homo sapiens; identical to SEQ ID NO: 32079
  Payload ID: 6283
  Gene Symbol: FBLN2
  Gene Name: fibulin 2
  Uniprot ID: P98095
  ENSP ID: ENSP00000420042

SEQ ID NO: 32082 - protein, 158 aa, Homo sapiens
  Payload ID: 6283
  Gene Symbol: FBLN2
  Gene Name: fibulin 2
  ENSP ID: ENSP00000420164
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCR

SEQ ID NO: 32083 - protein, 489 aa, Homo sapiens
  Payload ID: 6284
  Gene Symbol: FBLN5
  Gene Name: fibulin 5
  ENSP ID: ENSP00000267620
MPGIKRILTVTILALCLPSPGNAQAQCTNGFDLDRQSGQCLDGVSLSSPRLECNGAISAHCNLCLPGSSDSSASASQVAGITDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 32084 - protein, 448 aa, Homo sapiens
  Payload ID: 6284
  Gene Symbol: FBLN5
  Gene Name: fibulin 5
  Uniprot ID: Q9UBX5
  ENSP ID: ENSP00000345008
MPGIKRILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 32085 - protein, 35 aa, Homo sapiens
  Payload ID: 6284
  Gene Symbol: FBLN5
  Gene Name: fibulin 5
  ENSP ID: ENSP00000450787
MPGIKRILTVTILALCLPSPGNAQQQERWTPVCQP

SEQ ID NO: 32086 - protein, 44 aa, Homo sapiens
  Payload ID: 6284
  Gene Symbol: FBLN5
  Gene Name: fibulin 5
  ENSP ID: ENSP00000451002
MPGIKRILTVTILALCLPSPGNAQAQCTNGFDLDRQSGQCLASL

SEQ ID NO: 32087 - protein, 91 aa, Homo sapiens
  Payload ID: 6284
  Gene Symbol: FBLN5
  Gene Name: fibulin 5
  ENSP ID: ENSP00000451486
MPGIKRILTVTILALCLPSPGNAQAQCTNGFDLDRQSGQCLDIDECRTIPEACRGDMMCVNQNGGYLCIPRTNPVYRGPYSNPYSTPYSGP

SEQ ID NO: 32088 - protein, 453 aa, Homo sapiens
  Payload ID: 6284
  Gene Symbol: FBLN5
  Gene Name: fibulin 5
  ENSP ID: ENSP00000451982
MRSGNCRQRYMILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 32089 - protein, 261 aa, Homo sapiens
  Payload ID: 6285
  Gene Symbol: FBLN7
  Gene Name: fibulin 7
  ENSP ID: ENSP00000272559
AGSARTLGTARGGHGAGKGLSPTALLPARVASCARSQKAWPLCIIDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 32090 - protein, 439 aa, Homo sapiens
  Payload ID: 6285
  Gene Symbol: FBLN7
  Gene Name: fibulin 7
  Uniprot ID: Q53RD9
  ENSP ID: ENSP00000331411
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 32091 - protein, 366 aa, Homo sapiens
  Payload ID: 6285
  Gene Symbol: FBLN7
  Gene Name: fibulin 7
  ENSP ID: ENSP00000386295
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPLTWRGLRRWRWTSTCRNTWTAPSRPTTCPRSPSLYPPMTSEGTQGHWGVES

SEQ ID NO: 32092 - protein, 305 aa, Homo sapiens
  Payload ID: 6285
  Gene Symbol: FBLN7
  Gene Name: fibulin 7
  Uniprot ID: Q53RD9
  ENSP ID: ENSP00000386822
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 32093 - protein, 393 aa, Homo sapiens
  Payload ID: 6285
  Gene Symbol: FBLN7
  Gene Name: fibulin 7
  Uniprot ID: Q53RD9
  ENSP ID: ENSP00000387000
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 32094 - protein, 273 aa, Homo sapiens
  Payload ID: 6285
  Gene Symbol: FBLN7
  Gene Name: fibulin 7
  ENSP ID: ENSP00000388025
RFAEGIRHMKSRLAALQNSVGRVGPDALPGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGN

SEQ ID NO: 32095 - protein, 180 aa, Homo sapiens
  Payload ID: 6286
  Gene Symbol: FICD
  Gene Name: FIC domain containing
  ENSP ID: ENSP00000354421
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPESRRLGSQGGASQNTREWLWGHTDSDCIPPHGWGNRVVPGMLSTHDAAATSSSRPGTQAGHHGFLRRPAQGTAPRMSSAP

SEQ ID NO: 32096 - protein, 458 aa, Homo sapiens
  Payload ID: 6286
  Gene Symbol: FICD
  Gene Name: FIC domain containing
  Uniprot ID: Q9BVA6
  ENSP ID: ENSP00000446479
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPAGKLEARAALNQALEMKRQGKREKAQKLFMHALKMDPDFVDALTEFGIFSEEDKDIIQADYLYTRALTISPYHEKALVNRDRTLPLVEEIDQRYFSIIDSKVKKVMSIPKGNSALRRVMEETYYHHIYHTVAIEGNTLTLSEIRHILETRYAVPGKSLEEQNEVIGMHAAMKYINTTLVSRIGSVTISDVLEIHRRVLGYVDPVEAGRFRTTQVLVGHHIPPHPQDVEKQMQEFVQWLNSEEAMNLHPVEFAALAHYKLVYIHPFIDGNGRTSRLLMNLILMQAGYPPITIRKEQRSDYYHVLEAANEGDVRPFIRFIAKCTETTLDTLLFATTEYSVALPEAQPNHSGFKETLPVKP

SEQ ID NO: 32097 - protein, 139 aa, Homo sapiens
  Payload ID: 6286
  Gene Symbol: FICD
  Gene Name: FIC domain containing
  ENSP ID: ENSP00000447379
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPGKTDWPSSSMLVNWIDRHRMCHVLYVGHRGIVNKSALSS

SEQ ID NO: 32098 - protein, 56 aa, Homo sapiens
  Payload ID: 6286
  Gene Symbol: FICD
  Gene Name: FIC domain containing
  ENSP ID: ENSP00000449989
  MOD_RES (1)..(1): Any amino acid
XCLAVLKGLYLLRSKPDRAQHAATKCTSPSTELSITSRGATLLVAKTKASPGKCCT

SEQ ID NO: 32099 - protein, 275 aa, Homo sapiens
  Payload ID: 6287
  Gene Symbol: FCN2
  Gene Name: ficolin (collagen/fibrinogen domain containing lectin) 2
  Uniprot ID: Q15485
  ENSP ID: ENSP00000291741
MELDRAVGVLGAATLLLSFLGMAWALQAADTCPGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 32100 - protein, 313 aa, Homo sapiens
  Payload ID: 6287
  Gene Symbol: FCN2
  Gene Name: ficolin (collagen/fibrinogen domain containing lectin) 2
  Uniprot ID: Q15485
  ENSP ID: ENSP00000291744
MELDRAVGVLGAATLLLSFLGMAWALQAADTCPEVKMVGLEGSDKLTILRGCPGLPGAPGPKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 32101 - protein, 326 aa, Homo sapiens
  Payload ID: 6288
  Gene Symbol: FCN1
  Gene Name: ficolin (collagen/fibrinogen domain containing) 1
  Uniprot ID: O00602
  ENSP ID: ENSP00000360871
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 32102 - protein, 360 aa, Homo sapiens
  Payload ID: 6288
  Gene Symbol: FCN1
  Gene Name: ficolin (collagen/fibrinogen domain containing) 1
  ENSP ID: ENSP00000479379
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQTHSHDAHSCPFAPSSVKPPHAHNLTRGRIMFLNMFTLGQKSFTSFNVCFLNTSGFDHFPVSVARQVFPWNLVSREESGPLFSRWHYRCSGRLSDFCEDFPPPVIDTGRSSPPPPSLPHPPMPHSQHFTLLEKGHFGVQKTLTKKGESLVGTFLLPTTAEFMLWAGWLLGRDKHLALTK

SEQ ID NO: 32103 - protein, 299 aa, Homo sapiens
  Payload ID: 6289
  Gene Symbol: FCN3
  Gene Name: ficolin (collagen/fibrinogen domain containing) 3
  Uniprot ID: O75636
  ENSP ID: ENSP00000270879
MDLLWILPSLWLLLLGGPACLKTQEHPSCPGPRELEASKVVLLPSCPGAPGSPGEKGAPGPQGPPGPPGKMGPKGEPGDPVNLLRCQEGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 32104 - protein, 288 aa, Homo sapiens
  Payload ID: 6289
  Gene Symbol: FCN3
  Gene Name: ficolin (collagen/fibrinogen domain containing) 3
  Uniprot ID: O75636
  ENSP ID: ENSP00000347077
MDLLWILPSLWLLLLGGPACLKTQEHPSCPGPRELEASKVVLLPSCPGAPGSPGEKGAPGPQGPPGPPGKMGPKGEPGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 32105 - protein, 759 aa, Homo sapiens
  Payload ID: 6290
  Gene Symbol: FIGN
  Gene Name: fidgetin
  Uniprot ID: Q5HY92
  ENSP ID: ENSP00000333836
MISSTSVYGLKMQWTPEHAQWPEQHFDITSTTRSPAHKVEAYRGHLQRTYQYAWANDDISALTASNLLKKYAEKYSGILEGPVDRPVLSNYSDTPSGLVNGRKNESEPWQPSLNSEAVYPMNCVPDVITASKAGVSSALPPADVSASIGSSPGVASNLTEPSYSSSTCGSHTVPSLHAGLPSQEYAPGYNGSYLHSTYSSQPAPALPSPHPSPLHSSGLLQPPPPPPPPPALVPGYNGTSNLSSYSYPSASYPPQTAVGSGYSPGGAPPPPSAYLPSGIPAPTPLPPTTVPGYTYQGHGLTPIAPSALTNSSASSLKRKAFYMAGQGDMDSSYGNYSYGQQRSTQSPMYRMPDNSISNTNRGNGFDRSAETSSLAFKPTKQLMSSEQQRKFSSQSSRALTPPSYSTAKNSLGSRSSESFGKYTSPVMSEHGDEHRQLLSHPMQGPGLRAATSSNHSVDEQLKNTDTHLIDLVTNEIITQGPPVDWNDIAGLDLVKAVIKEEVLWPVLRSDAFSGLTALPRSILLFGPRGTGKTLLGRCIASQLGATFFKIAGSGLVAKWLGEAEKIIHASFLVARCRQPSVIFVSDIDMLLSSQVNEEHSPVSRMRTEFLMQLDTVLTSAEDQIVVICATSKPEEIDESLRRYFMKRLLIPLPDSTARHQIIVQLLSQHNYCLNDKEFALLVQRTEGFSGLDVAHLCQEAVVGPLHAMPATDLSAIMPSQLRPVTYQDFENAFCKIQPSISQKELDMYVEWNKMFGCSQ

SEQ ID NO: 32106 - protein, 29 aa, Homo sapiens
  Payload ID: 6290
  Gene Symbol: FIGN
  Gene Name: fidgetin
  ENSP ID: ENSP00000386768
MISSTSVYATWRQCFPAFFIPEADGGKAL

SEQ ID NO: 32107 - protein, 674 aa, Homo sapiens
  Payload ID: 6291
  Gene Symbol: FIGNL1
  Gene Name: fidgetin-like 1
  Uniprot ID: Q6PIW4
  ENSP ID: ENSP00000349356
MQTSSSRSVHLSEWQKNYFAITSGICTGPKADAYRAQILRIQYAWANSEISQVCATKLFKKYAEKYSAIIDSDNVESGLNNYAENILTLAGSQQTDSDKWQSGLSINNVFKMSSVQKMMQAGKKFKDSLLEPALASVVIHKEATVFDLPKFSVCGSSQESDSLPNSAHDRDRTQDFPESNRLKLLQNAQPPMVTNTARTCPTFSAPVGESATAKFHVTPLFGNVKKENHSSAKENIGLNVFLSNQSCFPAACENPQRKSFYGSGTIDALSNPILNKACSKTEDNGPKEDSSLPTFKTAKEQLWVDQQKKYHQPQRASGSSYGGVKKSLGASRSRGILGKFVPPIPKQDGGEQNGGMQCKPYGAGPTEPAHPVDERLKNLEPKMIELIMNEIMDHGPPVNWEDIAGVEFAKATIKEIVVWPMLRPDIFTGLRGPPKGILLFGPPGTGKTLIGKCIASQSGATFFSISASSLTSKWVGEGEKMVRALFAVARCQQPAVIFIDEIDSLLSQRGDGEHESSRRIKTEFLVQLDGATTSSEDRILVVGATNRPQEIDEAARRRLVKRLYIPLPEASARKQIVINLMSKEQCCLSEEEIEQIVQQSDAFSGADMTQLCREASLGPIRSLQTADIATITPDQVRPIAYIDFENAFRTVRPSVSPKDLELYENWNKTFGCGK

SEQ ID NO: 32108 - protein, 674 aa, Homo sapiens; identical to SEQ ID NO: 32107
  Payload ID: 6291
  Gene Symbol: FIGNL1
  Gene Name: fidgetin-like 1
  Uniprot ID: Q6PIW4
  ENSP ID: ENSP00000378924

SEQ ID NO: 32109 - protein, 97 aa, Homo sapiens
  Payload ID: 6291
  Gene Symbol: FIGNL1
  Gene Name: fidgetin-like 1
  ENSP ID: ENSP00000388471
MQTSSSRSVHLSEWQKNYFAITSGICTGPKADAYRAQILRIQYAWANSEISQVCATKLFKKYAEKYSAIIDSDNVESGLNNYAENILTLAGSQQTDS

SEQ ID NO: 32110 - protein, 125 aa, Homo sapiens
  Payload ID: 6291
  Gene Symbol: FIGNL1
  Gene Name: fidgetin-like 1
  ENSP ID: ENSP00000394070
MQTSSSRSVHLSEWQKNYFAITSGICTGPKADAYRAQILRIQYAWANSEISQVCATKLFKKYAEKYSAIIDSDNVESGLNNYAENILTLAGSQQTDSDKWQSGLSINNVFKMSSVQKMMQAGKKF

SEQ ID NO: 32111 - protein, 674 aa, Homo sapiens; identical to SEQ ID NO: 32107
  Payload ID: 6291
  Gene Symbol: FIGNL1
  Gene Name: fidgetin-like 1
  Uniprot ID: Q6PIW4
  ENSP ID: ENSP00000399997

SEQ ID NO: 32112 - protein, 35 aa, Homo sapiens
  Payload ID: 6291
  Gene Symbol: FIGNL1
  Gene Name: fidgetin-like 1
  ENSP ID: ENSP00000402957
MQTSSSRSVHLSEWQKNYFAITSGICTGPKADAYR

SEQ ID NO: 32113 - protein, 102 aa, Homo sapiens
  Payload ID: 6291
  Gene Symbol: FIGNL1
  Gene Name: fidgetin-like 1
  ENSP ID: ENSP00000403012
MQTSSSRSVHLSEWQKNYFAITSGICTGPKADAYRAQILRIQYAWANSEISQVCATKLFKKYAEKYSAIIDSDNVESGLNNYAENILTLAGSQQTDSDKWQS

SEQ ID NO: 32114 - protein, 53 aa, Homo sapiens
  Payload ID: 6291
  Gene Symbol: FIGNL1
  Gene Name: fidgetin-like 1
  ENSP ID: ENSP00000409281
MQTSSSRSVHLSEWQKNYFAITSGICTGPKADAYRAQILRIQYAWANSEISQV

SEQ ID NO: 32115 - protein, 67 aa, Homo sapiens
  Payload ID: 6291
  Gene Symbol: FIGNL1
  Gene Name: fidgetin-like 1
  ENSP ID: ENSP00000409674
MQTSSSRSVHLSEWQKNYFAITSGICTGPKADAYRAQILRIQYAWANSEISQDLNKQIVTSGSLDCQ

SEQ ID NO: 32116 - protein, 674 aa, Homo sapiens; identical to SEQ ID NO: 32107
  Payload ID: 6291
  Gene Symbol: FIGNL1
  Gene Name: fidgetin-like 1
  Uniprot ID: Q6PIW4
  ENSP ID: ENSP00000410811

SEQ ID NO: 32117 - protein, 674 aa, Homo sapiens; identical to SEQ ID NO: 32107
  Payload ID: 6291
  Gene Symbol: FIGNL1
  Gene Name: fidgetin-like 1
  Uniprot ID: Q6PIW4
  ENSP ID: ENSP00000481751

SEQ ID NO: 32118 - protein, 674 aa, Homo sapiens; identical to SEQ ID NO: 32107
  Payload ID: 6291
  Gene Symbol: FIGNL1
  Gene Name: fidgetin-like 1
  Uniprot ID: Q6PIW4
  ENSP ID: ENSP00000483126

SEQ ID NO: 32119 - protein, 674 aa, Homo sapiens; identical to SEQ ID NO: 32107
  Payload ID: 6291
  Gene Symbol: FIGNL1
  Gene Name: fidgetin-like 1
  Uniprot ID: Q6PIW4
  ENSP ID: ENSP00000483543

SEQ ID NO: 32120 - protein, 674 aa, Homo sapiens; identical to SEQ ID NO: 32107
  Payload ID: 6291
  Gene Symbol: FIGNL1
  Gene Name: fidgetin-like 1
  Uniprot ID: Q6PIW4
  ENSP ID: ENSP00000484551

SEQ ID NO: 32121 - protein, 907 aa, Homo sapiens
  Payload ID: 6292
  Gene Symbol: FIG4
  Gene Name: FIG4 phosphoinositide 5-phosphatase
  Uniprot ID: Q92562
  ENSP ID: ENSP00000230124
MPTAAAPIISSVQKLVLYETRARYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSGVFGICSEPYMKYVWNGELLDIIKSTVHRDWLLYIIHGFCGQSKLLIYGRPVYVTLIARRSSKFAGTRFLKRGANCEGDVANEVETEQILCDASVMSFTAGSYSSYVQVRGSVPLYWSQDISTMMPKPPITLDQADPFAHVAALHFDQMFQRFGSPIIILNLVKEREKRKHERILSEELVAAVTYLNQFLPPEHTIVYIPWDMAKYTKSKLCNVLDRLNVIAESVVKKTGFFVNRPDSYCSILRPDEKWNELGGCVIPTGRLQTGILRTNCVDCLDRTNTAQFMVGKCALAYQLYSLGLIDKPNLQFDTDAVRLFEELYEDHGDTLSLQYGGSQLVHRVKTYRKIAPWTQHSKDIMQTLSRYYSNAFSDADRQDSINLFLGVFHPTEGKPHLWELPTDFYLHHKNTMRLLPTRRSYTYWWTPEVIKHLPLPYDEVICAVNLKKLIVKKFHKYEEEIDIHNEFFRPYELSSFDDTFCLAMTSSARDFMPKTVGIDPSPFTVRKPDETGKSVLGNKSNREEAVLQRKTAASAPPPPSEEAVSSSSEDDSGTDREEEGSVSQRSTPVKMTDAGDSAKVTENVVQPMKELYGINLSDGLSEEDFSIYSRFVQLGQSQHKQDKNSQQPCSRCSDGVIKLTPISAFSQDNIYEVQPPRVDRKSTEIFQAHIQASQGIMQPLGKEDSSMYREYIRNRYL

SEQ ID NO: 32122 - protein, 139 aa, Homo sapiens
  Payload ID: 6292
  Gene Symbol: FIG4
  Gene Name: FIG4 phosphoinositide 5-phosphatase
  ENSP ID: ENSP00000357937
MGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSG

SEQ ID NO: 32123 - protein, 99 aa, Homo sapiens
  Payload ID: 6292
  Gene Symbol: FIG4
  Gene Name: FIG4 phosphoinositide 5-phosphatase
  ENSP ID: ENSP00000396566
MTSSARDFMPKTVGIDPSPFTVRKPDETGKSVLGNKSNREEAVLQRKTAASAPPPPSEEAVSSSSEDDSGTDREEEGSVSQRSTPVKMTDAGDSAKVTE

SEQ ID NO: 32124 - protein, 136 aa, Homo sapiens
  Payload ID: 6292
  Gene Symbol: FIG4
  Gene Name: FIG4 phosphoinositide 5-phosphatase
  ENSP ID: ENSP00000405660
  MOD_RES (1)..(1): Any amino acid
XLFEELYEDHGDTLSLQYGGSQLVHRVKTYRKIAPWTQHSKDIMQTLSRYYSNAFSDADRQDSINLFLGVFHPTEGKPHLWELPTDFYLHHKNTMRLLPTRRSYTYWWTPEVIKHLPLPYDEGFLARSPANLECSN

SEQ ID NO: 32125 - protein, 237 aa, Homo sapiens
  Payload ID: 6292
  Gene Symbol: FIG4
  Gene Name: FIG4 phosphoinositide 5-phosphatase
  ENSP ID: ENSP00000412156
MRYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSGVFGICSEPYMKYVWNGELLDIIKSTVHRDWLLYIIHGFCGQS

SEQ ID NO: 32126 - protein, 4061 aa, Homo sapiens
  Payload ID: 6293
  Gene Symbol: FLG
  Gene Name: filaggrin
  Uniprot ID: P20930
  ENSP ID: ENSP00000357789
MSTLLENIFAIINLFKQYSKKDKNTDTLSKKELKELLEKEFRQILKNPDDPDMVDVFMDHLDIDHNKKIDFTEFLLMVFKLAQAYYESTRKENLPISGHKHRKHSHHDKHEDNKQEENKENRKRPSSLERRNNRKGNKGRSKSPRETGGKRHESSSEKKERKGYSPTHREEEYGKNHHNSSKKEKNKTENTRLGDNRKRLSERLEEKEDNEEGVYDYENTGRMTQKWIQSGHIATYYTIQDEAYDTTDSLLEENKIYERSRSSDGKSSSQVNRSRHENTSQVPLQESRTRKRRGSRVSQDRDSEGHSEDSERHSGSASRNHHGSAWEQSRDGSRHPRSHDEDRASHGHSADSSRQSGTRHAETSSRGQTASSHEQARSSPGERHGSGHQQSADSSRHSATGRGQASSAVSDRGHRGSSGSQASDSEGHSENSDTQSVSGHGKAGLRQQSHQESTRGRSGERSGRSGSSLYQVSTHEQPDSAHGRTGTSTGGRQGSHHEQARDSSRHSASQEGQDTIRGHPGSSRGGRQGSHHEQSVNRSGHSGSHHSHTTSQGRSDASHGQSGSRSASRQTRNEEQSGDGTRHSGSRHHEASSQADSSRHSQVGQGQSSGPRTSRNQGSSVSQDSDSQGHSEDSERWSGSASRNHHGSAQEQSRDGSRHPRSHHEDRAGHGHSADSSRKSGTRHTQNSSSGQAASSHEQARSSAGERHGSRHQLQSADSSRHSGTGHGQASSAVRDSGHRGSSGSQATDSEGHSEDSDTQSVSGHGQAGHHQQSHQESARDRSGERSRRSGSFLYQVSTHKQSESSHGWTGPSTGVRQGSHHEQARDNSRHSASQDGQDTIRGHPGSSRRGRQGSHHEQSVDRSGHSGSHHSHTTSQGRSDASRGQSGSRSASRTTRNEEQSRDGSRHSGSRHHEASSHADISRHSQAGQGQSEGSRTSRRQGSSVSQDSDSEGHSEDSERWSGSASRNHRGSAQEQSRHGSRHPRSHHEDRAGHGHSADSSRQSGTPHAETSSGGQAASSHEQARSSPGERHGSRHQQSADSSRHSGIPRRQASSAVRDSGHWGSSGSQASDSEGHSEESDTQSVSGHGQDGPHQQSHQESARDWSGGRSGRSGSFIYQVSTHEQSESAHGRTRTSTGRRQGSHHEQARDSSRHSASQEGQDTIRAHPGSRRGGRQGSHHEQSVDRSGHSGSHHSHTTSQGRSDASHGQSGSRSASRQTRKDKQSGDGSRHSGSRHHEAASWADSSRHSQVGQEQSSGSRTSRHQGSSVSQDSDSERHSDDSERLSGSASRNHHGSSREQSRDGSRHPGFHQEDRASHGHSADSSRQSGTHHTESSSHGQAVSSHEQARSSPGERHGSRHQQSADSSRHSGIGHRQASSAVRDSGHRGSSGSQVTNSEGHSEDSDTQSVSAHGQAGPHQQSHKESARGQSGESSGRSRSFLYQVSSHEQSESTHGQTAPSTGGRQGSRHEQARNSSRHSASQDGQDTIRGHPGSSRGGRQGSYHEQSVDRSGHSGYHHSHTTPQGRSDASHGQSGPRSASRQTRNEEQSGDGSRHSGSRHHEPSTRAGSSRHSQVGQGESAGSKTSRRQGSSVSQDRDSEGHSEDSERRSESASRNHYGSAREQSRHGSRNPRSHQEDRASHGHSAESSRQSGTRHAETSSGGQAASSQEQARSSPGERHGSRHQQSADSSTDSGTGRRQDSSVVGDSGNRGSSGSQASDSEGHSEESDTQSVSAHGQAGPHQQSHQESTRGQSGERSGRSGSFLYQVSTHEQSESAHGRTGPSTGGRQRSRHEQARDSSRHSASQEGQDTIRGHPGSSRGGRQGSHYEQSVDSSGHSGSHHSHTTSQERSDVSRGQSGSRSVSRQTRNEKQSGDGSRHSGSRHHEASSRADSSRHSQVGQGQSSGPRTSRNQGSSVSQDSDSQGHSEDSERWSGSASRNHLGSAWEQSRDGSRHPGSHHEDRAGHGHSADSSRQSGTRHTESSSRGQAASSHEQARSSAGERHGSHHQLQSADSSRHSGIGHGQASSAVRDSGHRGYSGSQASDSEGHSEDSDTQSVSAQGKAGPHQQSHKESARGQSGESSGRSGSFLYQVSTHEQSESTHGQSAPSTGGRQGSHYDQAQDSSRHSASQEGQDTIRGHPGPSRGGRQGSHQEQSVDRSGHSGSHHSHTTSQGRSDASRGQSGSRSASRKTYDKEQSGDGSRHSGSHHHEASSWADSSRHSLVGQGQSSGPRTSRPRGSSVSQDSDSEGHSEDSERRSGSASRNHHGSAQEQSRDGSRHPRSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRTGTSTGGRQGSHHKQARDSSRHSTSQEGQDTIHGHPGSSSGGRQGSHYEQLVDRSGHSGSHHSHTTSQGRSDASHGHSGSRSASRQTRNDEQSGDGSRHSGSRHHEASSRADSSGHSQVGQGQSEGPRTSRNWGSSFSQDSDSQGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQDGQDTIRGHPGSSRGGRQGYHHEHSVDSSGHSGSHHSHTTSQGRSDASRGQSGSRSASRTTRNEEQSGDGSRHSGSRHHEASTHADISRHSQAVQGQSEGSRRSRRQGSSVSQDSDSEGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQYGQDTIRGHPGSSRGGRQGYHHEHSVDSSGHSGSHHSHTTSQGRSDASRGQSGSRSASRTTRNEEQSGDSSRHSVSRHHEASTHADISRHSQAVQGQSEGSRRSRRQGSSVSQDSDSEGHSEDSERWSGSASRNHRGSVQEQSRHGSRHPRSHHEDRAGHGHSADRSRQSGTRHAETSSGGQAASSHEQARSSPGERHGSRHQQSADSSRHSGIPRGQASSAVRDSRHWGSSGSQASDSEGHSEESDTQSVSGHGQAGPHQQSHQESARDRSGGRSGRSGSFLYQVSTHEQSESAHGRTRTSTGRRQGSHHEQARDSSRHSASQEGQDTIRGHPGSSRRGRQGSHYEQSVDRSGHSGSHHSHTTSQGRSDASRGQSGSRSASRQTRNDEQSGDGSRHSWSHHHEASTQADSSRHSQSGQGQSAGPRTSRNQGSSVSQDSDSQGHSEDSERWSGSASRNHRGSAQEQSRDGSRHPTSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRAGPSTGGRQGSRHEQARDSSRHSASQEGQDTIRGHPGSRRGGRQGSYHEQSVDRSGHSGSHHSHTTSQGRSDASHGQSGSRSASRETRNEEQSGDGSRHSGSRHHEASTQADSSRHSQSGQGESAGSRRSRRQGSSVSQDSDSEAYPEDSERRSESASRNHHGSSREQSRDGSRHPGSSHRDTASHVQSSPVQSDSSTAKEHGHFSSLSQDSAYHSGIQSRGSPHSSSSYHYQSEGTERQKGQSGLVWRHGSYGSADYDYGESGFRHSQHGSVSYNSNPVVFKERSDICKASAFGKDHPRYYATYINKDPGLCGHSSDISKQLGFSQSQRYYYYE

SEQ ID NO: 32127 - protein, 2391 aa, Homo sapiens
  Payload ID: 6294
  Gene Symbol: FLG2
  Gene Name: filaggrin family member 2
  Uniprot ID: Q5D862
  ENSP ID: ENSP00000373370
MTDLLRSVVTVIDVFYKYTKQDGECGTLSKGELKELLEKELHPVLKNPDDPDTVDVIMHMLDRDHDRRLDFTEFLLMIFKLTMACNKVLSKEYCKASGSKKHRRGHRHQEEESETEEDEEDTPGHKSGYRHSSWSEGEEHGYSSGHSRGTVKCRHGSNSRRLGRQGNLSSSGNQEGSQKRYHRSSCGHSWSGGKDRHGSSSVELRERINKSHISPSRESGEEYESGSGSNSWERKGHGGLSCGLETSGHESNSTQSRIREQKLGSSCSGSGDSGRRSHACGYSNSSGCGRPQNASSSCQSHRFGGQGNQFSYIQSGCQSGIKGGQGHGCVSGGQPSGCGQPESNPCSQSYSQRGYGARENGQPQNCGGQWRTGSSQSSCCGQYGSGGSQSCSNGQHEYGSCGRFSNSSSSNEFSKCDQYGSGSSQSTSFEQHGTGLSQSSGFEQHVCGSGQTCGQHESTSSQSLGYDQHGSSSGKTSGFGQHGSGSGQSSGFGQCGSGSGQSSGFGQHGSVSGQSSGFGQHGSVSGQSSGFGQHESRSRQSSYGQHGSGSSQSSGYGQYGSRETSGFGQHGLGSGQSTGFGQYGSGSGQSSGFGQHGSGSGQSSGFGQHESRSGQSSYGQHSSGSSQSSGYGQHGSRQTSGFGQHGSGSSQSTGFGQYGSGSGQSSGFGQHVSGSGQSSGFGQHESRSGHSSYGQHGFGSSQSSGYGQHGSSSGQTSGFGQHELSSGQSSSFGQHGSGSGQSSGFGQHGSGSGQSSGFGQHESRSGQSSYGQHSSGSSQSSGYGQHGSRQTSGFGQHGSGSSQSTGFGQYGSGSGQSAGFGQHGSGSGQSSGFGQHESRSHQSSYGQHGSGSSQSSGYGQHGSSSGQTSGFGQHRSSSGQYSGFGQHGSGSGQSSGFGQHGTGSGQYSGFGQHESRSHQSSYGQHGSGSSQSSGYGQHGSSSGQTFGFGQHRSGSGQSSGFGQHGSGSGQSSGFGQHESGSGKSSGFGQHESRSSQSNYGQHGSGSSQSSGYGQHGSSSGQTTGFGQHRSSSGQYSGFGQHGSGSDQSSGFGQHGTGSGQSSGFGQYESRSRQSSYGQHGSGSSQSSGYGQHGSNSGQTSGFGQHRPGSGQSSGFGQYGSGSGQSSGFGQHGSGTGKSSGFAQHEYRSGQSSYGQHGTGSSQSSGCGQHESGSGPTTSFGQHVSGSDNFSSSGQHISDSGQSTGFGQYGSGSGQSTGLGQGESQQVESGSTVHGRQETTHGQTINTTRHSQSGQGQSTQTGSRVTRRRRSSQSENSDSEVHSKVSHRHSEHIHTQAGSHYPKSGSTVRRRQGTTHGQRGDTTRHGHSGHGQSTQTGSRTSGRQRFSHSDATDSEVHSGVSHRPHSQEQTHSQAGSQHGESESTVHERHETTYGQTGEATGHGHSGHGQSTQRGSRTTGRRGSGHSESSDSEVHSGGSHRPQSQEQTHGQAGSQHGESGSTVHGRHGTTHGQTGDTTRHAHYHHGKSTQRGSSTTGRRGSGHSESSDSEVHSGGSHTHSGHTHGQSGSQHGESESIIHDRHRITHGQTGDTTRHSYSGHEQTTQTGSRTTGRQRTSHSESTDSEVHSGGSHRPHSREHTYGQAGSQHEEPEFTVHERHGTTHGQIGDTTGHSHSGHGQSTQRGSRTTGRQRSSHSESSDSEVHSGVSHTHTGHTHGQAGSQHGQSESIVPERHGTTHGQTGDTTRHAHYHHGLTTQTGSRTTGRRGSGHSEYSDSEGYSGVSHTHSGHTHGQARSQHGESESIVHERHGTIHGQTGDTTRHAHSGHGQSTQTGSRTTGRRSSGHSEYSDSEGHSGFSQRPHSRGHTHGQAGSQHGESESIVDERHGTTHGQTGDTSGHSQSGHGQSTQSGSSTTGRRRSGHSESSDSEVHSGGSHTHSGHTHSQARSQHGESESTVHKRHQTTHGQTGDTTEHGHPSHGQTIQTGSRTTGRRGSGHSEYSDSEGPSGVSHTHSGHTHGQAGSHYPESGSSVHERHGTTHGQTADTTRHGHSGHGQSTQRGSRTTGRRASGHSEYSDSEGHSGVSHTHSGHAHGQAGSQHGESGSSVHERHGTTHGQTGDTTRHAHSGHGQSTQRGSRTAGRRGSGHSESSDSEVHSGVSHTHSGHTYGQARSQHGESGSAIHGRQGTIHGQTGDTTRHGQSGHGQSTQTGSRTTGRQRSSHSESSDSEVHSEASPTHSGHTHSQAGSRHGQSGSSGHGRQGTTHGQTGDTTRHAHYGYGQSTQRGSRTTGRRGSGHSESSDSEVHSWGSHTHSGHIQGQAGSQQRQPGSTVHGRLETTHGQTGDTTRHGHSGYGQSTQTGSRSSRASHFQSHSSERQRHGSSQVWKHGSYGPAEYDYGHTGYGPSGGSRKSISNSHLSWSTDSTANKQLSRH

SEQ ID NO: 32128 - protein, 1213 aa, Homo sapiens
  Payload ID: 6295
  Gene Symbol: FILIP1
  Gene Name: filamin A interacting protein 1
  Uniprot ID: Q7Z7B0
  ENSP ID: ENSP00000237172
MRSRNQGGESASDGHISCPKPSIIGNAGEKSLSEDAKKKKKSNRKEDDVMASGTVKRHLKTSGECERKTKKSLELSKEDLIQLLSIMEGELQAREDVIHMLKTEKTKPEVLEAHYGSAEPEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKGMKAGKPVVAAPGAGNLTKFEPRAETQSMKIELKKSAASSTTSLGGGKG

SEQ ID NO: 32129 - protein, 1114 aa, Homo sapiens
  Payload ID: 6295
  Gene Symbol: FILIP1
  Gene Name: filamin A interacting protein 1
  ENSP ID: ENSP00000359037
MLKTEKTKPEVLEAHYGSAEPEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKGMKAGKPVVAAPGAGNLTKFEPRAETQSMKIELKKSAASSTTSLGGGKG

SEQ ID NO: 32130 - protein, 1177 aa, Homo sapiens
  Payload ID: 6295
  Gene Symbol: FILIP1
  Gene Name: filamin A interacting protein 1
  Uniprot ID: Q7Z7B0
  ENSP ID: ENSP00000376728
MRSRNQGGESASDGHISCPKPSIIGNAGEKSLSEDAKKKKKSNRKEDDVMASGTVKRHLKTSGECERKTKKSLELSKEDLIQLLSIMEGELQAREDVIHMLKTEKTKPEVLEAHYGSAEPEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKESIIIHQLRMNSR

SEQ ID NO: 32131 - protein, 1133 aa, Homo sapiens
  Payload ID: 6296
  Gene Symbol: FILIP1L
  Gene Name: filamin A interacting protein 1-like
  Uniprot ID: Q4L180
  ENSP ID: ENSP00000327880
MRSRGSDTEGSAQKKFPRHTKGHSFQGPKNMKHRQQDKDSPSESDVILPCPKAEKPHSGNGHQAEDLSRDDLLFLLSILEGELQARDEVIGILKAEKMDLALLEAQYGFVTPKKVLEALQRDAFQAKSTPWQEDIYEKPMNELDKVVEKHKESYRRILGQLLVAEKSRRQTILELEEEKRKHKEYMEKSDEFICLLEQECERLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVSNIYN

SEQ ID NO: 32132 - protein, 1135 aa, Homo sapiens
  Payload ID: 6296
  Gene Symbol: FILIP1L
  Gene Name: filamin A interacting protein 1-like
  Uniprot ID: Q4L180
  ENSP ID: ENSP00000346560
MRSRGSDTEGSAQKKFPRHTKGHSFQGPKNMKHRQQDKDSPSESDVILPCPKAEKPHSGNGHQAEDLSRDDLLFLLSILEGELQARDEVIGILKAEKMDLALLEAQYGFVTPKKVLEALQRDAFQAKSTPWQEDIYEKPMNELDKVVEKHKESYRRILGQLLVAEKSRRQTILELEEEKRKHKEYMEKSDEFICLLEQECERLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVEPLLLPH

SEQ ID NO: 32133 - protein, 893 aa, Homo sapiens
  Payload ID: 6296
  Gene Symbol: FILIP1L
  Gene Name: filamin A interacting protein 1-like
  Uniprot ID: Q4L180
  ENSP ID: ENSP00000373192
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVSNIYN

SEQ ID NO: 32134 - protein, 255 aa, Homo sapiens
  Payload ID: 6296
  Gene Symbol: FILIP1L
  Gene Name: filamin A interacting protein 1-like
  Uniprot ID: Q4L180
  ENSP ID: ENSP00000381371
MRSRGSDTEGSAQKKFPRHTKGHSFQGPKNMKHRQQDKDSPSESDVILPCPKAEKPHSGNGHQAEDLSRDDLLFLLSILEGELQARDEVIGILKAEKMDLALLEAQYGFVTPKKVLEALQRDAFQAKSTPWQEDIYEKPMNELDKVVEKHKESYRRILGQLLVAEKSRRQTILELEEEKRKHKEYMEKSDEFICLLEQECERWSLALLPRLECNGMILAHCNLCLLGSSDSPASAFQVAGITGTRHHAQLVFVFL

SEQ ID NO: 32135 - protein, 148 aa, Homo sapiens
  Payload ID: 6296
  Gene Symbol: FILIP1L
  Gene Name: filamin A interacting protein 1-like
  ENSP ID: ENSP00000417617
PTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITIKEVCKQRIPARIPKPKSTGITKISTKAPTVPMDKPIYQNGC

SEQ ID NO: 32136 - protein, 711 aa, Homo sapiens
  Payload ID: 6296
  Gene Symbol: FILIP1L
  Gene Name: filamin A interacting protein 1-like
  Uniprot ID: Q4L180
  ENSP ID: ENSP00000417774
MALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVEPLLLPH

SEQ ID NO: 32137 - protein, 895 aa, Homo sapiens
  Payload ID: 6296
  Gene Symbol: FILIP1L
  Gene Name: filamin A interacting protein 1-like
  Uniprot ID: Q4L180
  ENSP ID: ENSP00000419642
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVEPLLLPH

SEQ ID NO: 32138 - protein, 837 aa, Homo sapiens
  Payload ID: 6296
  Gene Symbol: FILIP1L
  Gene Name: filamin A interacting protein 1-like
  ENSP ID: ENSP00000419874
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASP

SEQ ID NO: 32139 - protein, 2639 aa, Homo sapiens
  Payload ID: 6297
  Gene Symbol: FLNA
  Gene Name: filamin A, alpha
  Uniprot ID: P21333
  ENSP ID: ENSP00000353467
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 32140 - protein, 2607 aa, Homo sapiens
  Payload ID: 6297
  Gene Symbol: FLNA
  Gene Name: filamin A, alpha
  ENSP ID: ENSP00000358863
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 32141 - protein, 2647 aa, Homo sapiens
  Payload ID: 6297
  Gene Symbol: FLNA
  Gene Name: filamin A, alpha
  Uniprot ID: P21333
  ENSP ID: ENSP00000358866
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 32142 - protein, 2620 aa, Homo sapiens
  Payload ID: 6297
  Gene Symbol: FLNA
  Gene Name: filamin A, alpha
  ENSP ID: ENSP00000358872
MPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 32143 - protein, 281 aa, Homo sapiens
  Payload ID: 6297
  Gene Symbol: FLNA
  Gene Name: filamin A, alpha
  ENSP ID: ENSP00000397824
LVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQ

SEQ ID NO: 32144 - protein, 232 aa, Homo sapiens
  Payload ID: 6297
  Gene Symbol: FLNA
  Gene Name: filamin A, alpha
  ENSP ID: ENSP00000398215
  MOD_RES (1)..(1): Any amino acid
XKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGDDSMRMSHLKVGSAADIPINISETDLSLLTATVVPPSGREEPCLLKRLRNGHV

SEQ ID NO: 32145 - protein, 90 aa, Homo sapiens
  Payload ID: 6297
  Gene Symbol: FLNA
  Gene Name: filamin A, alpha
  ENSP ID: ENSP00000405458
  MOD_RES (1)..(1): Any amino acid
XEQHVPGSPFTARVTGDDSMRMSHLKVGSAADIPINISETDLSLLTATVVPPSGREEPCLLKRLRNGHVAMPCVQGFHSCPRRRGSTWCM

SEQ ID NO: 32146 - protein, 604 aa, Homo sapiens
  Payload ID: 6297
  Gene Symbol: FLNA
  Gene Name: filamin A, alpha
  ENSP ID: ENSP00000408921
AAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPRRGAREAEGPGGWRVWLRVLPHGPWNLYRHHHVGWSEHRAQSLRSEGGHRVWQSEGTGLGPWAGGRRRWQVSRLCGGGYRGRRGHAGLLGGRAIAG

SEQ ID NO: 32147 - protein, 2639 aa, Homo sapiens; identical to SEQ ID NO: 32139
  Payload ID: 6297
  Gene Symbol: FLNA
  Gene Name: filamin A, alpha
  Uniprot ID: P21333
  ENSP ID: ENSP00000416926

SEQ ID NO: 32148 - protein, 2315 aa, Homo sapiens
  Payload ID: 6297
  Gene Symbol: FLNA
  Gene Name: filamin A, alpha
  ENSP ID: ENSP00000480593
MPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINIAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 32149 - protein, 2602 aa, Homo sapiens
  Payload ID: 6298
  Gene Symbol: FLNB
  Gene Name: filamin B, beta
  Uniprot ID: O75369
  ENSP ID: ENSP00000295956
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 32150 - protein, 2578 aa, Homo sapiens
  Payload ID: 6298
  Gene Symbol: FLNB
  Gene Name: filamin B, beta
  Uniprot ID: O75369
  ENSP ID: ENSP00000351339
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 32151 - protein, 195 aa, Homo sapiens
  Payload ID: 6298
  Gene Symbol: FLNB
  Gene Name: filamin B, beta
  ENSP ID: ENSP00000414532
MYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGRNTSLAALFMSQCLKTVFSNPGESSCGCFCCLFVIHFIQSPPACLWG

SEQ ID NO: 32152 - protein, 2591 aa, Homo sapiens
  Payload ID: 6298
  Gene Symbol: FLNB
  Gene Name: filamin B, beta
  Uniprot ID: O75369
  ENSP ID: ENSP00000415599
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 32153 - protein, 2409 aa, Homo sapiens
  Payload ID: 6298
  Gene Symbol: FLNB
  Gene Name: filamin B, beta
  ENSP ID: ENSP00000418510
MQEHSTRRRSLSLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 32154 - protein, 72 aa, Homo sapiens
  Payload ID: 6298
  Gene Symbol: FLNB
  Gene Name: filamin B, beta
  ENSP ID: ENSP00000419954
FADEHVPGSPFTVKISGEGRVKESITRTSRAPSVATVGSICDLNLKIPGVRVMNCSAQILWGWRVQFHTGSR

SEQ ID NO: 32155 - protein, 135 aa, Homo sapiens
  Payload ID: 6298
  Gene Symbol: FLNB
  Gene Name: filamin B, beta
  ENSP ID: ENSP00000420199
  MOD_RES (1)..(1): Any amino acid
XLAVEGPSKVDIQTEDLEDGTCKVSYFPTVPGVYIVSTKFADEHVPEINSSDMSAHVTSPSGRVTEAEIVPMGKNSHCVRFVPQEMGVHTVSVKYRGQHVTGSPFQFTVGPLGEGGAHKVRAGGPGLERGEAGVP

SEQ ID NO: 32156 - protein, 2633 aa, Homo sapiens
  Payload ID: 6298
  Gene Symbol: FLNB
  Gene Name: filamin B, beta
  Uniprot ID: O75369
  ENSP ID: ENSP00000420213
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRADDTDSQSWRSPLKALSEFFKGDPKGDFNKTGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 32157 - protein, 276 aa, Homo sapiens
  Payload ID: 6299
  Gene Symbol: FBLIM1
  Gene Name: filamin binding LIM protein 1
  Uniprot ID: Q8WUP2
  ENSP ID: ENSP00000364920
MASKPEKRVASSVFITLAPPRRDVAVAEEVRQAVCEARRGRPWEAPAPMKTPEAGLAGRPSPWTTPGRAAATVPAAPMQLFNGDICAFCHKTVSPRELAVEAMKRQYHAQCFTCRTCRRQLAGQSFYQKDGRPLCEPCYQDTLERCGKCGEVVRDHIIRALGQAFHPSCFTCVTCARCIGDESFALGSQNEVYCLDDFYRKFAPVCSICENPIIPRDGKDAFKIECMGRNFHENCYRCEDCRILLSVEPTDQGCYPLNNHLFCKPCHVKRSAAGCC

SEQ ID NO: 32158 - protein, 373 aa, Homo sapiens
  Payload ID: 6299
  Gene Symbol: FBLIM1
  Gene Name: filamin binding LIM protein 1
  Uniprot ID: Q8WUP2
  ENSP ID: ENSP00000364921
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDLLPPPPPPPPVLLPSEEEAPAPMGASLIADLEQLHLSPPPPPPQAPAEGPSVQPGPLRPMEEELPPPPAEPVEKGASTDICAFCHKTVSPRELAVEAMKRQYHAQCFTCRTCRRQLAGQSFYQKDGRPLCEPCYQDTLERCGKCGEVVRDHIIRALGQAFHPSCFTCVTCARCIGDESFALGSQNEVYCLDDFYRKFAPVCSICENPIIPRDGKDAFKIECMGRNFHENCYRCEDCRILLSVEPTDQGCYPLNNHLFCKPCHVKRSAAGCC

SEQ ID NO: 32159 - protein, 373 aa, Homo sapiens; identical to SEQ ID NO: 32158
  Payload ID: 6299
  Gene Symbol: FBLIM1
  Gene Name: filamin binding LIM protein 1
  Uniprot ID: Q8WUP2
  ENSP ID: ENSP00000364926

SEQ ID NO: 32160 - protein, 17 aa, Homo sapiens
  Payload ID: 6299
  Gene Symbol: FBLIM1
  Gene Name: filamin binding LIM protein 1
  ENSP ID: ENSP00000387595
MASKPEKRVASSVFITL

SEQ ID NO: 32161 - protein, 104 aa, Homo sapiens
  Payload ID: 6299
  Gene Symbol: FBLIM1
  Gene Name: filamin binding LIM protein 1
  ENSP ID: ENSP00000402401
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDLL

SEQ ID NO: 32162 - protein, 374 aa, Homo sapiens
  Payload ID: 6299
  Gene Symbol: FBLIM1
  Gene Name: filamin binding LIM protein 1
  Uniprot ID: Q8WUP2
  ENSP ID: ENSP00000416387
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDLLPPPPPPPPVLLPSEEEAPAPMGASLIADLEQLHLSPPPPPPQAPAEGPSVQPGPLRPMEEELPPPPAEPVEKGASTDICAFCHKTVSPRELAVEAMKRQYHAQCFTCRTCRRQLAGQSFYQKDGRPLCEPCYQDTLERCGKCGEVVRDHIIRALGQAFHPSCFTCVTCARCIGDESFALGSQNEVYCLDDFYRYEKGLCTGWGAGTGRDPSRVKELSLSPGCWARVSCLLVYYKEYYRAGLGAVAHACNPSTLGGRGGWITRSGDRDHPG

SEQ ID NO: 32163 - protein, 14 aa, Homo sapiens
  Payload ID: 6299
  Gene Symbol: FBLIM1
  Gene Name: filamin binding LIM protein 1
  ENSP ID: ENSP00000421764
MASKPEKRVASSVF

SEQ ID NO: 32164 - protein, 78 aa, Homo sapiens
  Payload ID: 6299
  Gene Symbol: FBLIM1
  Gene Name: filamin binding LIM protein 1
  ENSP ID: ENSP00000421885
MASKPEKRVASSVFITLAPPRRDVAVAEEVRQAVCEARRGRPWEAPAPMKTPEAGLAGRPSPWTTPGRAAATVPAAPM

SEQ ID NO: 32165 - protein, 31 aa, Homo sapiens
  Payload ID: 6299
  Gene Symbol: FBLIM1
  Gene Name: filamin binding LIM protein 1
  ENSP ID: ENSP00000422075
MASKPEKRVASSVFITLAPPRRDVAVAEEVR

SEQ ID NO: 32166 - protein, 30 aa, Homo sapiens
  Payload ID: 6299
  Gene Symbol: FBLIM1
  Gene Name: filamin binding LIM protein 1
  ENSP ID: ENSP00000422862
MASKPEKRVASSVFITLAPPRRDVAVAEEV

SEQ ID NO: 32167 - protein, 34 aa, Homo sapiens
  Payload ID: 6299
  Gene Symbol: FBLIM1
  Gene Name: filamin binding LIM protein 1
  ENSP ID: ENSP00000423471
MASKPEKRVASSVFITLAPPRRDVAVAEEVRQAV

SEQ ID NO: 32168 - protein, 144 aa, Homo sapiens
  Payload ID: 6299
  Gene Symbol: FBLIM1
  Gene Name: filamin binding LIM protein 1
  ENSP ID: ENSP00000424920
MASKPEKRVASSVFITLAPPRRDVAVAEEVRQAVCEARRGRPWEAPAPMKTPEAGLAGRPSPWTTPGRAAATVPAAPMQLFNGDICAFCHKTVSPRELAVEAMKRQYHAQCFTCRTCRRQLAGQSFYQKDGRPLCEPCYQDTLE

SEQ ID NO: 32169 - protein, 144 aa, Homo sapiens
  Payload ID: 6299
  Gene Symbol: FBLIM1
  Gene Name: filamin binding LIM protein 1
  ENSP ID: ENSP00000427052
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDLLPPPPPPPPVLLPSEEEAPAPMGASLIADLEQLHLSPPPPP

SEQ ID NO: 32170 - protein, 2725 aa, Homo sapiens
  Payload ID: 6300
  Gene Symbol: FLNC
  Gene Name: filamin C, gamma
  Uniprot ID: Q14315
  ENSP ID: ENSP00000327145
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 32171 - protein, 2692 aa, Homo sapiens
  Payload ID: 6300
  Gene Symbol: FLNC
  Gene Name: filamin C, gamma
  Uniprot ID: Q14315
  ENSP ID: ENSP00000344002
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 32172 - protein, 211 aa, Homo sapiens
  Payload ID: 6301
  Gene Symbol: FIBIN
  Gene Name: fin bud initiation factor homolog (zebrafish)
  Uniprot ID: Q8TAL6
  ENSP ID: ENSP00000321962
MVFLKFFCMSFFCHLCQGYFDGPLYPEMSNGTLHHYFVPDGDYEENDDPEKCQLLFRVSDHRRCSQGEGSQVGSLLSLTLREEFTVLGRQVEDAGRVLEGISKSISYDLDGEESYGKYLRRESHQIGDAYSNSDKSLTELESKFKQGQEQDSRQESRLNEDFLGMLVHTRSLLKETLDISVGLRDKYELLALTIRSHGTRLGRLKNDYLKV

SEQ ID NO: 32173 - protein, 87 aa, Homo sapiens
  Payload ID: 6302
  Gene Symbol: FAU
  Gene Name: Finkel-Biskis-Reilly murine sarcoma virus (FBR-MuSV) ubiquitously expressed
  ENSP ID: ENSP00000279259
MQLFVRAQELHTFEVTGQETVAQIKAHVASLEGIAPEDQVVLLAGAPLEDEATLGQCGVEALTTLEVAGRMLGGGQTGEEEEEDRSG

SEQ ID NO: 32174 - protein, 75 aa, Homo sapiens
  Payload ID: 6302
  Gene Symbol: FAU
  Gene Name: Finkel-Biskis-Reilly murine sarcoma virus (FBR-MuSV) ubiquitously expressed
  ENSP ID: ENSP00000413848
MQLFVRAQELHTFEVTGQETVAQIKAHVASLEGIAPEDQVVLLAGAPLEDEATLGQCGVEALTTLEVAGRMLGGE

SEQ ID NO: 32175 - protein, 133 aa, Homo sapiens
  Payload ID: 6302
  Gene Symbol: FAU
  Gene Name: Finkel-Biskis-Reilly murine sarcoma virus (FBR-MuSV) ubiquitously expressed
  Uniprot ID: P62861
  ENSP ID: ENSP00000431822
MQLFVRAQELHTFEVTGQETVAQIKAHVASLEGIAPEDQVVLLAGAPLEDEATLGQCGVEALTTLEVAGRMLGGKVHGSLARAGKVRGQTPKVAKQEKKKKKTGRAKRRMQYNRRFVNVVPTFGKKKGPNANS

SEQ ID NO: 32176 - protein, 108 aa, Homo sapiens
  Payload ID: 6302
  Gene Symbol: FAU
  Gene Name: Finkel-Biskis-Reilly murine sarcoma virus (FBR-MuSV) ubiquitously expressed
  ENSP ID: ENSP00000433139
MQLFVRAQELHTFEVTGQETVAQIKAHVASLEGIAPEDQVVLLAGAPLEDEATLGQCGVEALTTLEVAGRMLGGKVHGSLARAGKVRGQTPKVAKQEKKKKKTGRAKR

SEQ ID NO: 32177 - protein, 133 aa, Homo sapiens; identical to SEQ ID NO: 32175
  Payload ID: 6302
  Gene Symbol: FAU
  Gene Name: Finkel-Biskis-Reilly murine sarcoma virus (FBR-MuSV) ubiquitously expressed
  Uniprot ID: P62861
  ENSP ID: ENSP00000434440

SEQ ID NO: 32178 - protein, 75 aa, Homo sapiens; identical to SEQ ID NO: 32174
  Payload ID: 6302
  Gene Symbol: FAU
  Gene Name: Finkel-Biskis-Reilly murine sarcoma virus (FBR-MuSV) ubiquitously expressed
  ENSP ID: ENSP00000434680

SEQ ID NO: 32179 - protein, 133 aa, Homo sapiens; identical to SEQ ID NO: 32175
  Payload ID: 6302
  Gene Symbol: FAU
  Gene Name: Finkel-Biskis-Reilly murine sarcoma virus (FBR-MuSV) ubiquitously expressed
  Uniprot ID: P62861
  ENSP ID: ENSP00000435370

SEQ ID NO: 32180 - protein, 98 aa, Homo sapiens
  Payload ID: 6302
  Gene Symbol: FAU
  Gene Name: Finkel-Biskis-Reilly murine sarcoma virus (FBR-MuSV) ubiquitously expressed
  ENSP ID: ENSP00000436110
MQLFVRAQELHTFEVTGQETVAQIKALTTLEVAGRMLGGKVHGSLARAGKVRGQTPKVAKQEKKKKKTGRAKRRMQYNRRFVNVVPTFGKKKGPNANS

SEQ ID NO: 32181 - protein, 152 aa, Homo sapiens
  Payload ID: 6303
  Gene Symbol: FIS1
  Gene Name: fission, mitochondrial 1
  Uniprot ID: Q9Y3D6
  ENSP ID: ENSP00000223136
MEAVLNELVSVEDLLKFEKKFQSEKAAGSVSKSTQFEYAWCLVRSKYNDDIRKGIVLLEELLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 32182 - protein, 90 aa, Homo sapiens
  Payload ID: 6303
  Gene Symbol: FIS1
  Gene Name: fission, mitochondrial 1
  ENSP ID: ENSP00000395964
MEAVLNELVSVEDLLVRPGPDRGKGKVGGRVLRRVRAAAQREQGGTAGLRLLPGRGELPAQGIREGLKVRPRVAADRAPEQPGQGTGAAH

SEQ ID NO: 32183 - protein, 46 aa, Homo sapiens
  Payload ID: 6303
  Gene Symbol: FIS1
  Gene Name: fission, mitochondrial 1
  ENSP ID: ENSP00000411442
MEAVLNELVSVEDLLSCCPKGARRNSGITSSTWPWGTTGSRNTRRP

SEQ ID NO: 32184 - protein, 155 aa, Homo sapiens
  Payload ID: 6303
  Gene Symbol: FIS1
  Gene Name: fission, mitochondrial 1
  ENSP ID: ENSP00000413500
MKLERSLKRNFSLRRQQARCPRARSLSTPGAWCGASTMMTSVKASCCSRSCCPKGARRNSGITSSTWPWGTTGSRWTRGHGHRGRHGPGCGGTGRTHRTCCVQVQILKETREPTENAPGGPVHPRCPFPVLPLPPVSILCGLQLISAPLRFVLQP

SEQ ID NO: 32185 - protein, 59 aa, Homo sapiens
  Payload ID: 6303
  Gene Symbol: FIS1
  Gene Name: fission, mitochondrial 1
  ENSP ID: ENSP00000442056
MKLERAAAQREQGGTAGLRLLPGRGELPAQGIREGLKVRPRVAADRAPEQPGQGTGAAH

SEQ ID NO: 32186 - protein, 80 aa, Homo sapiens
  Payload ID: 6303
  Gene Symbol: FIS1
  Gene Name: fission, mitochondrial 1
  ENSP ID: ENSP00000444771
MKLERSLKRNFSLRRQQARCPRARSLSTPGAWCGASTMMTSVKASCCSRSCCPKGARRNSGITSSTWPWGTTGSRNTRRP

SEQ ID NO: 32187 - protein, 404 aa, Homo sapiens
  Payload ID: 6304
  Gene Symbol: FZR1
  Gene Name: fizzy/cell division cycle 20 related 1
  Uniprot ID: Q9UM11
  ENSP ID: ENSP00000321800
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKESVSVLNLFTRIR

SEQ ID NO: 32188 - protein, 496 aa, Homo sapiens
  Payload ID: 6304
  Gene Symbol: FZR1
  Gene Name: fizzy/cell division cycle 20 related 1
  Uniprot ID: Q9UM11
  ENSP ID: ENSP00000378529
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTYSLSTKRSSPDDGNDVSPYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKVKWESVSVLNLFTRIR

SEQ ID NO: 32189 - protein, 493 aa, Homo sapiens
  Payload ID: 6304
  Gene Symbol: FZR1
  Gene Name: fizzy/cell division cycle 20 related 1
  Uniprot ID: Q9UM11
  ENSP ID: ENSP00000410369
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTYSLSTKRSSPDDGNDVSPYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKESVSVLNLFTRIR

SEQ ID NO: 32190 - protein, 361 aa, Homo sapiens
  Payload ID: 6304
  Gene Symbol: FZR1
  Gene Name: fizzy/cell division cycle 20 related 1
  ENSP ID: ENSP00000467967
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTYSLSTKRSSPDDGNDVSPYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKDNHCSVSTRAPKCAIWPGPSTPTSW

SEQ ID NO: 32191 - protein, 582 aa, Homo sapiens
  Payload ID: 6305
  Gene Symbol: FKBP10
  Gene Name: FK506 binding protein 10, 65 kDa
  Uniprot ID: Q96AY3
  ENSP ID: ENSP00000317232
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 32192 - protein, 81 aa, Homo sapiens
  Payload ID: 6305
  Gene Symbol: FKBP10
  Gene Name: FK506 binding protein 10, 65 kDa
  ENSP ID: ENSP00000408232
MGDFVRYHYNGTFEDGKKFDSSYDRNTLVAIVVGVGRLITGMDRGLMGMCVNERRRLIVPPHLGYGSIGLAGLIPPDATLY

SEQ ID NO: 32193 - protein, 386 aa, Homo sapiens
  Payload ID: 6305
  Gene Symbol: FKBP10
  Gene Name: FK506 binding protein 10, 65 kDa
  ENSP ID: ENSP00000416822
  MOD_RES (1)..(1): Any amino acid
XIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTDSIGFLQGSAPLRPFRSGEGQPSLGREGGYGKTEPAYPQDPAVLGASVSSPVKWASHADPQGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 32194 - protein, 171 aa, Homo sapiens
  Payload ID: 6305
  Gene Symbol: FKBP10
  Gene Name: FK506 binding protein 10, 65 kDa
  ENSP ID: ENSP00000466097
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMV

SEQ ID NO: 32195 - protein, 147 aa, Homo sapiens
  Payload ID: 6305
  Gene Symbol: FKBP10
  Gene Name: FK506 binding protein 10, 65 kDa
  ENSP ID: ENSP00000466352
MFPAGPPSHSLLRLPLLQLLLLVVQAVGRGLGRASPAGGPLEDVVIERYHIPRACPREVQMGDFVRYHYNGTFEDGKKFDSSGAHSTGCHPLLRCGSAGCVEQGRHRAGEHIAAPAPLPPHGPGRRLCPLPLQWHPAGRHLLRHQLQ

SEQ ID NO: 32196 - protein, 172 aa, Homo sapiens
  Payload ID: 6305
  Gene Symbol: FKBP10
  Gene Name: FK506 binding protein 10, 65 kDa
  ENSP ID: ENSP00000468703
MGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIP

SEQ ID NO: 32197 - protein, 92 aa, Homo sapiens
  Payload ID: 6306
  Gene Symbol: FKBP11
  Gene Name: FK506 binding protein 11, 19 kDa
  ENSP ID: ENSP00000256680
MTLRPSLLPLHLLLLLLLSAAVCRAEAGLETESPVRTLQVETLGRERDLWKSIRDPCSPIVGGAPRTMCRARCFWRHASHTLHGKLGRWTYY

SEQ ID NO: 32198 - protein, 146 aa, Homo sapiens
  Payload ID: 6306
  Gene Symbol: FKBP11
  Gene Name: FK506 binding protein 11, 19 kDa
  Uniprot ID: Q9NYL4
  ENSP ID: ENSP00000396874
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPGTKDNLMRPPGMTSSSQ

SEQ ID NO: 32199 - protein, 99 aa, Homo sapiens
  Payload ID: 6306
  Gene Symbol: FKBP11
  Gene Name: FK506 binding protein 11, 19 kDa
  ENSP ID: ENSP00000412403
MCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 32200 - protein, 63 aa, Homo sapiens
  Payload ID: 6306
  Gene Symbol: FKBP11
  Gene Name: FK506 binding protein 11, 19 kDa
  ENSP ID: ENSP00000447411
SLTRDPLVIELGQKQVIPGLEQSLLDMCVGWKNSCFGCEDSGGFAEGASAGLRLLAYLSCLWL

SEQ ID NO: 32201 - protein, 182 aa, Homo sapiens
  Payload ID: 6306
  Gene Symbol: FKBP11
  Gene Name: FK506 binding protein 11, 19 kDa
  ENSP ID: ENSP00000447911
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPDGVSLLLPRLECNSAIFTHHNLRHPGSSNSPVSASRVAGITGMRHHDRLILYF

SEQ ID NO: 32202 - protein, 72 aa, Homo sapiens
  Payload ID: 6306
  Gene Symbol: FKBP11
  Gene Name: FK506 binding protein 11, 19 kDa
  ENSP ID: ENSP00000448805
MTLRPSLLPLHLLLLLLLSAAVCRAEAGLETESPVRTLQVETLSDRRWSPQNHVPSPLLLETRFTYTTREAW

SEQ ID NO: 32203 - protein, 201 aa, Homo sapiens
  Payload ID: 6306
  Gene Symbol: FKBP11
  Gene Name: FK506 binding protein 11, 19 kDa
  Uniprot ID: Q9NYL4
  ENSP ID: ENSP00000449751
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 32204 - protein, 211 aa, Homo sapiens
  Payload ID: 6307
  Gene Symbol: FKBP14
  Gene Name: FK506 binding protein 14, 22 kDa
  Uniprot ID: Q9NWM8
  ENSP ID: ENSP00000222803
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDKDGFISAREFTYKHDEL

SEQ ID NO: 32205 - protein, 89 aa, Homo sapiens
  Payload ID: 6307
  Gene Symbol: FKBP14
  Gene Name: FK506 binding protein 14, 22 kDa
  ENSP ID: ENSP00000403279
  MOD_RES (1)..(1): Any amino acid
XVLQKPFICHRKTKGGDLMLVHYEGYLEKDGSLFHSTHKHNNGQPIWFTLGILEALKGWDQGLKGMCVGEKRKLIIPPALGYGKEGKVF

SEQ ID NO: 32206 - protein, 66 aa, Homo sapiens
  Payload ID: 6307
  Gene Symbol: FKBP14
  Gene Name: FK506 binding protein 14, 22 kDa
  ENSP ID: ENSP00000406270
MRLFLWNAVLTLFVTSLIGALIPEPEVKIEVLQKPFICHRKTKGGDLMLVHYEGYLEKDGSLFHST

SEQ ID NO: 32207 - protein, 1219 aa, Homo sapiens
  Payload ID: 6308
  Gene Symbol: FKBP15
  Gene Name: FK506 binding protein 15, 133kDa
  Uniprot ID: Q5T1M5
  ENSP ID: ENSP00000238256
MFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQPYAGMQAYAYPQASAVTSQLQPVRPLYPAPLSQPPHFQGSGDMASFLMTEARQHNTEIRMAVSKVADKMDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 32208 - protein, 497 aa, Homo sapiens
  Payload ID: 6308
  Gene Symbol: FKBP15
  Gene Name: FK506 binding protein 15, 133kDa
  ENSP ID: ENSP00000415733
DVGGDRPWDSGNTQLPPRNPVKANAMFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQVTFYNRINYIL

SEQ ID NO: 32209 - protein, 1244 aa, Homo sapiens
  Payload ID: 6308
  Gene Symbol: FKBP15
  Gene Name: FK506 binding protein 15, 133kDa
  ENSP ID: ENSP00000416158
DVGGDRPWDSGNTQLPPRNPVKANAMFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQPYAGMQAYAYPQASAVTSQLQPVRPLYPAPLSQPPHFQGSGDMASFLMTEARQHNTEIRMAVSKVADKMDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 32210 - protein, 103 aa, Homo sapiens
  Payload ID: 6309
  Gene Symbol: FKBP1A
  Gene Name: FK506 binding protein 1A, 12kDa
  ENSP ID: ENSP00000371134
MPVSVSSGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 32211 - protein, 108 aa, Homo sapiens
  Payload ID: 6309
  Gene Symbol: FKBP1A
  Gene Name: FK506 binding protein 1A, 12kDa
  Uniprot ID: P62942
  ENSP ID: ENSP00000371138
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 32212 - protein, 103 aa, Homo sapiens; identical to SEQ ID NO: 32210
  Payload ID: 6309
  Gene Symbol: FKBP1A
  Gene Name: FK506 binding protein 1A, 12kDa
  ENSP ID: ENSP00000371143

SEQ ID NO: 32213 - protein, 108 aa, Homo sapiens; identical to SEQ ID NO: 32211
  Payload ID: 6309
  Gene Symbol: FKBP1A
  Gene Name: FK506 binding protein 1A, 12kDa
  Uniprot ID: P62942
  ENSP ID: ENSP00000383003

SEQ ID NO: 32214 - protein, 92 aa, Homo sapiens
  Payload ID: 6309
  Gene Symbol: FKBP1A
  Gene Name: FK506 binding protein 1A, 12kDa
  ENSP ID: ENSP00000409863
MGVQVETISPGDGMLEDGKKFDSSRDRNKPFKFMLGKQEVIRGWEEGVAQMSVGQRAKLTISPDYAYGATGHPGIIPPHATLVFDVELLKLE

SEQ ID NO: 32215 - protein, 97 aa, Homo sapiens
  Payload ID: 6309
  Gene Symbol: FKBP1A
  Gene Name: FK506 binding protein 1A, 12kDa
  ENSP ID: ENSP00000478093
MGVQVETISPGDGRTFPKRGQTCVVHYTDECGSESQTDYISRLCLWCHWAPRHHPTTCHSRLRCGASKTGMTGMASSLSSLFLDLPWRDLVPPDMCT

SEQ ID NO: 32216 - protein, 37 aa, Homo sapiens
  Payload ID: 6309
  Gene Symbol: FKBP1A
  Gene Name: FK506 binding protein 1A, 12kDa
  ENSP ID: ENSP00000480846
MGVQVETISPGDGRTFPKRGQTCVVHYTGGDCILVNE

SEQ ID NO: 32217 - protein, 129 aa, Homo sapiens
  Payload ID: 6309
  Gene Symbol: FKBP1A
  Gene Name: FK506 binding protein 1A, 12kDa
  ENSP ID: ENSP00000482758
MGVQVETISPGDGRTFPKRGQTCVVHYTGMLEDGKKFDSSRDRNKPFKFMLGKQEVIRGWEEGVAQVCSLICFVLLSSIYLLYFFIGGIFIRFKNKKSEKSHPHAIPSDQYPHKKLLLLMFLVLWFKHI

SEQ ID NO: 32218 - protein, 108 aa, Homo sapiens
  Payload ID: 6310
  Gene Symbol: FKBP1B
  Gene Name: FK506 binding protein 1B, 12.6 kDa
  Uniprot ID: P68106
  ENSP ID: ENSP00000370373
MGVEIETISPGDGRTFPKKGQTCVVHYTGMLQNGKKFDSSRDRNKPFKFRIGKQEVIKGFEEGAAQMSLGQRAKLTCTPDVAYGATGHPGVIPPNATLIFDVELLNLE

SEQ ID NO: 32219 - protein, 80 aa, Homo sapiens
  Payload ID: 6310
  Gene Symbol: FKBP1B
  Gene Name: FK506 binding protein 1B, 12.6 kDa
  Uniprot ID: P68106
  ENSP ID: ENSP00000370379
MGVEIETISPGDGRTFPKKGQTCVVHYTGMLQNGKKFDSSRDRNKPFKFRIGKQEVIKGFEEGAAQLGPLSPLPICPHPC

SEQ ID NO: 32220 - protein, 42 aa, Homo sapiens
  Payload ID: 6310
  Gene Symbol: FKBP1B
  Gene Name: FK506 binding protein 1B, 12.6 kDa
  ENSP ID: ENSP00000397444
  MOD_RES (1)..(1): Any amino acid
XPKKGQTCVVHYTASLVGMIKEAWKANSFPLLPARAIHGASF

SEQ ID NO: 32221 - protein, 79 aa, Homo sapiens
  Payload ID: 6310
  Gene Symbol: FKBP1B
  Gene Name: FK506 binding protein 1B, 12.6 kDa
  ENSP ID: ENSP00000406593
MLQNGKKFDSSRDRNKPFKFRIGKQEVIKGFEEGAAQMSLGQRAKLTCTPDVAYGATGHPGVIPPNATLIFDVELLNLE

SEQ ID NO: 32222 - protein, 57 aa, Homo sapiens
  Payload ID: 6310
  Gene Symbol: FKBP1B
  Gene Name: FK506 binding protein 1B, 12.6 kDa
  ENSP ID: ENSP00000416349
MGVEIETISPGDGRTFPKKGQTCVVHYTASLVGMIKEAWKANSFPLLPARAIHGASF

SEQ ID NO: 32223 - protein, 108 aa, Homo sapiens
  Payload ID: 6311
  Gene Symbol: FKBP1C
  Gene Name: FK506 binding protein 1C
  ENSP ID: ENSP00000359693
MGVHVETISPGDWRTFPKRSQTCVMHYTGMLEDGKKFDSSRDRNKPFKFMLGKQEVIRGWEEGVVQMSVGQRAKLTISPDYAYGATGHPGIIPPHATLVFDVELLKLE

SEQ ID NO: 32224 - protein, 142 aa, Homo sapiens
  Payload ID: 6312
  Gene Symbol: FKBP2
  Gene Name: FK506 binding protein 2, 13kDa
  Uniprot ID: P26885
  ENSP ID: ENSP00000310935
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 32225 - protein, 142 aa, Homo sapiens; identical to SEQ ID NO: 32224
  Payload ID: 6312
  Gene Symbol: FKBP2
  Gene Name: FK506 binding protein 2, 13kDa
  Uniprot ID: P26885
  ENSP ID: ENSP00000378046

SEQ ID NO: 32226 - protein, 142 aa, Homo sapiens; identical to SEQ ID NO: 32224
  Payload ID: 6312
  Gene Symbol: FKBP2
  Gene Name: FK506 binding protein 2, 13kDa
  Uniprot ID: P26885
  ENSP ID: ENSP00000398147

SEQ ID NO: 32227 - protein, 102 aa, Homo sapiens
  Payload ID: 6312
  Gene Symbol: FKBP2
  Gene Name: FK506 binding protein 2, 13kDa
  ENSP ID: ENSP00000438749
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKR

SEQ ID NO: 32228 - protein, 224 aa, Homo sapiens
  Payload ID: 6313
  Gene Symbol: FKBP3
  Gene Name: FK506 binding protein 3, 25kDa
  Uniprot ID: Q00688
  ENSP ID: ENSP00000216330
MAAAVPQRAWTVEQLRSEQLPKKDIIKFLQEHGSDSFLAEHKLLGNIKNVAKTANKDHLVTAYNHLFETKRFKGTESISKVSEQVKNVKLNEDKPKETKSEETLDEGPPKYTKSVLKKGDKTNFPKKGDVVHCWYTGTLQDGTVFDTNIQTSAKKKKNAKPLSFKVGVGKVIRGWDEALLTMSKGEKARLEIEPEWAYGKKGQPDAKIPPNAKLTFEVELVDID

SEQ ID NO: 32229 - protein, 224 aa, Homo sapiens; identical to SEQ ID NO: 32228
  Payload ID: 6313
  Gene Symbol: FKBP3
  Gene Name: FK506 binding protein 3, 25kDa
  Uniprot ID: Q00688
  ENSP ID: ENSP00000379374

SEQ ID NO: 32230 - protein, 65 aa, Homo sapiens
  Payload ID: 6313
  Gene Symbol: FKBP3
  Gene Name: FK506 binding protein 3, 25kDa
  ENSP ID: ENSP00000452322
MAAAVPQRAWTVEQLRSEQLPKKDIIKFLQEHGSDSAGVQWRDLGSLQPPPPGFKRFSCLCLSSS

SEQ ID NO: 32231 - protein, 459 aa, Homo sapiens
  Payload ID: 6314
  Gene Symbol: FKBP4
  Gene Name: FK506 binding protein 4, 59kDa
  Uniprot ID: Q02790
  ENSP ID: ENSP00000001008
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 32232 - protein, 84 aa, Homo sapiens
  Payload ID: 6314
  Gene Symbol: FKBP4
  Gene Name: FK506 binding protein 4, 59kDa
  ENSP ID: ENSP00000438491
  MOD_RES (1)..(1): Any amino acid
XVNDFELARADFQKVLQLYPNNKAAKTQLAVCQQRIRRQLAREKKLYANMFERLAEEENKAPWLTPAIPALCRAKVGGSLEPSR

SEQ ID NO: 32233 - protein, 51 aa, Homo sapiens
  Payload ID: 6314
  Gene Symbol: FKBP4
  Gene Name: FK506 binding protein 4, 59kDa
  ENSP ID: ENSP00000439703
MTAEEMKATESGAQSAPLPMEGVDISPKQDEGVLKIIGDLKRLLQRLSCGM

SEQ ID NO: 32234 - protein, 23 aa, Homo sapiens
  Payload ID: 6314
  Gene Symbol: FKBP4
  Gene Name: FK506 binding protein 4, 59kDa
  ENSP ID: ENSP00000442193
  MOD_RES (1)..(1): Any amino acid
XKEEQKSNTAGSQSQIRKPRLRS

SEQ ID NO: 32235 - protein, 86 aa, Homo sapiens
  Payload ID: 6314
  Gene Symbol: FKBP4
  Gene Name: FK506 binding protein 4, 59kDa
  ENSP ID: ENSP00000446368
MPMIGDRVFVHYTGWLLDGTKFDSSLDRKDKFSFDLGKGEVIKAWDIAIATMKVGEVCHITCKPEYAYGSAGSPPKIPPNATLVFE

SEQ ID NO: 32236 - protein, 51 aa, Homo sapiens; identical to SEQ ID NO: 32233
  Payload ID: 6314
  Gene Symbol: FKBP4
  Gene Name: FK506 binding protein 4, 59kDa
  ENSP ID: ENSP00000486800

SEQ ID NO: 32237 - protein, 457 aa, Homo sapiens
  Payload ID: 6315
  Gene Symbol: FKBP5
  Gene Name: FK506 binding protein 5
  Uniprot ID: Q13451
  ENSP ID: ENSP00000349811
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRYGFGEAGKPKFGIEPNAELIYEVTLKSFEKAKESWEMDTKEKLEQAAIVKEKGTVYFKGGKYMQAVIQYGKIVSWLEMEYGLSEKESKASESFLLAAFLNLAMCYLKLREYTKAVECCDKALGLDSANEKGLYRRGEAQLLMNEFESAKGDFEKVLEVNPQNKAARLQISMCQKKAKEHNERDRRIYANMFKKFAEQDAKEEANKAMGKKTSEGVTNEKGTDSQAMEEEKPEGHV

SEQ ID NO: 32238 - protein, 457 aa, Homo sapiens; identical to SEQ ID NO: 32237
  Payload ID: 6315
  Gene Symbol: FKBP5
  Gene Name: FK506 binding protein 5
  Uniprot ID: Q13451
  ENSP ID: ENSP00000441205

SEQ ID NO: 32239 - protein, 268 aa, Homo sapiens
  Payload ID: 6315
  Gene Symbol: FKBP5
  Gene Name: FK506 binding protein 5
  Uniprot ID: Q13451
  ENSP ID: ENSP00000442340
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRPKNPGRWIPKKNWSRLPLSKRREPYTSRCVSPYAILSISKNLFKCW

SEQ ID NO: 32240 - protein, 457 aa, Homo sapiens; identical to SEQ ID NO: 32237
  Payload ID: 6315
  Gene Symbol: FKBP5
  Gene Name: FK506 binding protein 5
  Uniprot ID: Q13451
  ENSP ID: ENSP00000444810

SEQ ID NO: 32241 - protein, 327 aa, Homo sapiens
  Payload ID: 6316
  Gene Symbol: FKBP6
  Gene Name: FK506 binding protein 6, 36kDa
  Uniprot ID: O75344
  ENSP ID: ENSP00000252037
MGGSALNQGVLEGDDAPGQSLYERLSQRMLDISGDRGVLKDVIREGAGDLVAPDASVLVKYSGYLEHMDRPFDSNYFRKTPRLMKLGEDITLWGMELGLLSMRRGELARFLFKPNYAYGTLGCPPLIPPNTTVLFEIELLDFLDCAESDKFCALSAEQQDQFPLQKVLKVAATEREFGNYLFRQNRFYDAKVRYKRALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLASCYRDYVDKEKEMWHRMFAPCGDGSTAGES

SEQ ID NO: 32242 - protein, 297 aa, Homo sapiens
  Payload ID: 6316
  Gene Symbol: FKBP6
  Gene Name: FK506 binding protein 6, 36kDa
  Uniprot ID: O75344
  ENSP ID: ENSP00000394952
MGGSALNQGVLEGDDAPGQSLYERLSQRMLDISGDRGVLKDVIREGAGDLVAPDASVLDITLWGMELGLLSMRRGELARFLFKPNYAYGTLGCPPLIPPNTTVLFEIELLDFLDCAESDKFCALSAEQQDQFPLQKVLKVAATEREFGNYLFRQNRFYDAKVRYKRALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLASCYRDYVDKEKEMWHRMFAPCGDGSTAGES

SEQ ID NO: 32243 - protein, 252 aa, Homo sapiens
  Payload ID: 6316
  Gene Symbol: FKBP6
  Gene Name: FK506 binding protein 6, 36kDa
  ENSP ID: ENSP00000402360
MSASSWPQNGMPPSSLYERLSQRMLDISGDRGVLKDVIREGAGDLVAPDASVLVKYSGYLEHMDRPFDSNYFRKTPRLMKLGEDITLWGMELGLLSMRRGELARFLFKPNYAYGTLGCPPLIPPNTTVLFEIELLDFLDCAESDKFCALSAALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLA

SEQ ID NO: 32244 - protein, 199 aa, Homo sapiens
  Payload ID: 6316
  Gene Symbol: FKBP6
  Gene Name: FK506 binding protein 6, 36kDa
  ENSP ID: ENSP00000403908
MGGSALNQGVLEGDDAPGQSLYERLSQRMLDISGDRGVLKDVIREGAGDLVAPDASVLVKYSGYLEHMDRPFDSNYFRKTPRLMKLGEDITLWGMELGLLSMRRGELARFLFKPNYAYGTLGCPPLIPPNTTVLFEIELLDFLDCAESDKFCALSAEQQDQFPLQKVLKVAATEREFGNYLFRQNRFYDAKAPCWVCCG

SEQ ID NO: 32245 - protein, 101 aa, Homo sapiens
  Payload ID: 6316
  Gene Symbol: FKBP6
  Gene Name: FK506 binding protein 6, 36kDa
  ENSP ID: ENSP00000415891
MGGSALNQGVLEGDDAPGQSLYERLSQRMLDISGDRGVLKDVIREGAGDLVAPDASVLVKYSGYLEHMDRPFDSNYFRKTPRLMKLGEGRFRVGAGEEGIV

SEQ ID NO: 32246 - protein, 322 aa, Homo sapiens
  Payload ID: 6316
  Gene Symbol: FKBP6
  Gene Name: FK506 binding protein 6, 36kDa
  Uniprot ID: O75344
  ENSP ID: ENSP00000416277
MSASSWPQNGMPPSSLYERLSQRMLDISGDRGVLKDVIREGAGDLVAPDASVLVKYSGYLEHMDRPFDSNYFRKTPRLMKLGEDITLWGMELGLLSMRRGELARFLFKPNYAYGTLGCPPLIPPNTTVLFEIELLDFLDCAESDKFCALSAEQQDQFPLQKVLKVAATEREFGNYLFRQNRFYDAKVRYKRALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLASCYRDYVDKEKEMWHRMFAPCGDGSTAGES

SEQ ID NO: 32247 - protein, 127 aa, Homo sapiens
  Payload ID: 6317
  Gene Symbol: FKBP7
  Gene Name: FK506 binding protein 7
  ENSP ID: ENSP00000233092
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYGST

SEQ ID NO: 32248 - protein, 67 aa, Homo sapiens
  Payload ID: 6317
  Gene Symbol: FKBP7
  Gene Name: FK506 binding protein 7
  ENSP ID: ENSP00000389914
  MOD_RES (1)..(1): Any amino acid
XGYLAKDGSKFYCSRTQNEGHPKWFVLGVGQVIKGLDIAMTDMCPGEKRKVVIPPSFAYGKEGYGST

SEQ ID NO: 32249 - protein, 86 aa, Homo sapiens
  Payload ID: 6317
  Gene Symbol: FKBP7
  Gene Name: FK506 binding protein 7
  ENSP ID: ENSP00000398869
MPKTMHFLFRFIVFFYLWGLFTAQRQKKEESTEEVKIEVLHRPENCSKTSKKGDLLNAHYDGYLAKDGSKFYCSRRQDSTGCYIDF

SEQ ID NO: 32250 - protein, 74 aa, Homo sapiens
  Payload ID: 6317
  Gene Symbol: FKBP7
  Gene Name: FK506 binding protein 7
  ENSP ID: ENSP00000403801
MPKTMHFLFRFIVFFYLWGLFTAQRQKKEESTEEVKIEVLHRPENCSKTSKKGDLLNAHYDGYLAKDGSKFYCR

SEQ ID NO: 32251 - protein, 222 aa, Homo sapiens
  Payload ID: 6317
  Gene Symbol: FKBP7
  Gene Name: FK506 binding protein 7
  Uniprot ID: Q9Y680
  ENSP ID: ENSP00000413152
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 32252 - protein, 221 aa, Homo sapiens
  Payload ID: 6317
  Gene Symbol: FKBP7
  Gene Name: FK506 binding protein 7
  Uniprot ID: Q9Y680
  ENSP ID: ENSP00000415486
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 32253 - protein, 412 aa, Homo sapiens
  Payload ID: 6318
  Gene Symbol: FKBP8
  Gene Name: FK506 binding protein 8, 38kDa
  Uniprot ID: Q14318
  ENSP ID: ENSP00000222308
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 32254 - protein, 249 aa, Homo sapiens
  Payload ID: 6318
  Gene Symbol: FKBP8
  Gene Name: FK506 binding protein 8, 38kDa
  ENSP ID: ENSP00000441267
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVI

SEQ ID NO: 32255 - protein, 413 aa, Homo sapiens
  Payload ID: 6318
  Gene Symbol: FKBP8
  Gene Name: FK506 binding protein 8, 38kDa
  Uniprot ID: Q14318
  ENSP ID: ENSP00000471700
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 32256 - protein, 163 aa, Homo sapiens
  Payload ID: 6318
  Gene Symbol: FKBP8
  Gene Name: FK506 binding protein 8, 38kDa
  ENSP ID: ENSP00000472043
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLM

SEQ ID NO: 32257 - protein, 167 aa, Homo sapiens
  Payload ID: 6318
  Gene Symbol: FKBP8
  Gene Name: FK506 binding protein 8, 38kDa
  ENSP ID: ENSP00000472087
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGE

SEQ ID NO: 32258 - protein, 412 aa, Homo sapiens; identical to SEQ ID NO: 32253
  Payload ID: 6318
  Gene Symbol: FKBP8
  Gene Name: FK506 binding protein 8, 38kDa
  Uniprot ID: Q14318
  ENSP ID: ENSP00000472302

SEQ ID NO: 32259 - protein, 257 aa, Homo sapiens
  Payload ID: 6318
  Gene Symbol: FKBP8
  Gene Name: FK506 binding protein 8, 38kDa
  ENSP ID: ENSP00000472643
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAK

SEQ ID NO: 32260 - protein, 204 aa, Homo sapiens
  Payload ID: 6318
  Gene Symbol: FKBP8
  Gene Name: FK506 binding protein 8, 38kDa
  ENSP ID: ENSP00000472731
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTA

SEQ ID NO: 32261 - protein, 116 aa, Homo sapiens
  Payload ID: 6318
  Gene Symbol: FKBP8
  Gene Name: FK506 binding protein 8, 38kDa
  ENSP ID: ENSP00000472921
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGPGSQCPTHGRGGDGHGHC

SEQ ID NO: 32262 - protein, 182 aa, Homo sapiens
  Payload ID: 6318
  Gene Symbol: FKBP8
  Gene Name: FK506 binding protein 8, 38kDa
  ENSP ID: ENSP00000475588
  MOD_RES (1)..(1): Any amino acid
XGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKTIHAELSKLVKKHAAQRSTETALYRKMLGNPSRLPAKCPGKGAWSIPWKWLFGATAVALGGVALSVVIAARN

SEQ ID NO: 32263 - protein, 103 aa, Homo sapiens
  Payload ID: 6318
  Gene Symbol: FKBP8
  Gene Name: FK506 binding protein 8, 38kDa
  ENSP ID: ENSP00000475895
  MOD_RES (1)..(1): Any amino acid
XSQLKLDHYRAALRSCSLVLEHQPDNIKALFRKGKVLAQQGEYSEAIPILRAALKLEPSNKLPLPSADDPRRALKAGEEACGAAEHGDRLVPENAGQPQPAAC

SEQ ID NO: 32264 - protein, 413 aa, Homo sapiens; identical to SEQ ID NO: 32255
  Payload ID: 6318
  Gene Symbol: FKBP8
  Gene Name: FK506 binding protein 8, 38kDa
  Uniprot ID: Q14318
  ENSP ID: ENSP00000476767

SEQ ID NO: 32265 - protein, 23 aa, Homo sapiens
  Payload ID: 6318
  Gene Symbol: FKBP8
  Gene Name: FK506 binding protein 8, 38kDa
  ENSP ID: ENSP00000477278
MASCAEPSEPSAPLPAGVPPLED

SEQ ID NO: 32266 - protein, 570 aa, Homo sapiens
  Payload ID: 6319
  Gene Symbol: FKBP9
  Gene Name: FK506 binding protein 9, 63 kDa
  Uniprot ID: O95302
  ENSP ID: ENSP00000242209
MAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 32267 - protein, 225 aa, Homo sapiens
  Payload ID: 6319
  Gene Symbol: FKBP9
  Gene Name: FK506 binding protein 9, 63 kDa
  ENSP ID: ENSP00000391034
MAGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGV

SEQ ID NO: 32268 - protein, 623 aa, Homo sapiens
  Payload ID: 6319
  Gene Symbol: FKBP9
  Gene Name: FK506 binding protein 9, 63 kDa
  Uniprot ID: O95302
  ENSP ID: ENSP00000439250
MAFRGWRPPPPPLLLLLLWVTGQAAPVAGLGSDAELQIERRFVPDECPRTVRSGDFVRYHYVGTFPDGQKFDSRYWDTAEDKADKSPCPQVRVGVNTSPSCRLKQKGVGIYWKDLQFLVRVQNHGLSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 32269 - protein, 338 aa, Homo sapiens
  Payload ID: 6319
  Gene Symbol: FKBP9
  Gene Name: FK506 binding protein 9, 63 kDa
  Uniprot ID: O95302
  ENSP ID: ENSP00000441317
MAGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 32270 - protein, 349 aa, Homo sapiens
  Payload ID: 6320
  Gene Symbol: FKBPL
  Gene Name: FK506 binding protein like
  Uniprot ID: Q9UIM3
  ENSP ID: ENSP00000364298
METPPVNTIGEKDTSQPQQEWEKNLRENLDSVIQIRQQPRDPPTETLELEVSPDPASQILEHTQGAEKLVAELEGDSHKSHGSTSQMPEALQASDLWYCPDGSFVKKIVIRGHGLDKPKLGSCCRVLALGFPFGSGPPEGWTELTMGVGPWREETWGELIEKCLESMCQGEEAELQLPGHSGPPVRLTLASFTQGRDSWELETSEKEALAREERARGTELFRAGNPEGAARCYGRALRLLLTLPPPGPPERTVLHANLAACQLLLGQPQLAAQSCDRVLEREPGHLKALYRRGVAQAALGNLEKATADLKKVLAIDPKNRAAQEELGKVVIQGKNQDAGLAQGLRKMFG

SEQ ID NO: 32271 - protein, 349 aa, Homo sapiens; identical to SEQ ID NO: 32270
  Payload ID: 6320
  Gene Symbol: FKBPL
  Gene Name: FK506 binding protein like
  Uniprot ID: Q9UIM3
  ENSP ID: ENSP00000397530

SEQ ID NO: 32272 - protein, 349 aa, Homo sapiens; identical to SEQ ID NO: 32270
  Payload ID: 6320
  Gene Symbol: FKBPL
  Gene Name: FK506 binding protein like
  Uniprot ID: Q9UIM3
  ENSP ID: ENSP00000398812

SEQ ID NO: 32273 - protein, 349 aa, Homo sapiens
  Payload ID: 6320
  Gene Symbol: FKBPL
  Gene Name: FK506 binding protein like
  Uniprot ID: Q9UIM3
  ENSP ID: ENSP00000412439
METPPVNTIGEKDTSQPQQEWEKNLRENLDSVIQIRQQPRDPPTETLELEVSPDPASQILEHTQGAEKLVAELEGDSHKSHGSTSQMPETLQASDLWYCPDGSFVKKIVIRGHGLDKPKLGSCCRVLALGFPFGSGPPEGWTELTMGVGPWREETWGELIEKCLESMCQGEEAELQLPGHSGPPVRLTLASFTQGRDSWELETSEKEALAREERARGTELFRAGNPEGAARCYGRALRLLLTLPPPGPPERTVLHANLAACQLLLGQPQLAAQSCDRVLEREPGHLKALYRRGVAQAALGNLEKATADLKKVLAIDPKNRAAQEELGKVVIQGKNQDAGLAQGLRKMFG

SEQ ID NO: 32274 - protein, 380 aa, Homo sapiens
  Payload ID: 6321
  Gene Symbol: FEN1
  Gene Name: flap structure-specific endonuclease 1
  Uniprot ID: P39748
  ENSP ID: ENSP00000305480
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 32275 - protein, 165 aa, Homo sapiens
  Payload ID: 6321
  Gene Symbol: FEN1
  Gene Name: flap structure-specific endonuclease 1
  ENSP ID: ENSP00000445692
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAA

SEQ ID NO: 32276 - protein, 154 aa, Homo sapiens
  Payload ID: 6321
  Gene Symbol: FEN1
  Gene Name: flap structure-specific endonuclease 1
  ENSP ID: ENSP00000460402
  MOD_RES (1)..(1): Any amino acid
XLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKP

SEQ ID NO: 32277 - protein, 587 aa, Homo sapiens
  Payload ID: 6322
  Gene Symbol: FLAD1
  Gene Name: flavin adenine dinucleotide synthetase 1
  Uniprot ID: Q8NFF5
  ENSP ID: ENSP00000292180
MGWDLGTRLFQRQEQRSRLSRIWLEKTRVFLEGSTRTPALPHCLFWLLQVPSTQDPLFPGYGPQCPVDLAGPPCLRPLFGGLGGYWRALQRGREGRTMTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 32278 - protein, 170 aa, Homo sapiens
  Payload ID: 6322
  Gene Symbol: FLAD1
  Gene Name: flavin adenine dinucleotide synthetase 1
  ENSP ID: ENSP00000295530
MKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGNYLMFQTPSRSCISAASPLSLSWNSFYRTLSREQAIPENQIASPPSEAKGAEEPWMGPFPGQQG

SEQ ID NO: 32279 - protein, 490 aa, Homo sapiens
  Payload ID: 6322
  Gene Symbol: FLAD1
  Gene Name: flavin adenine dinucleotide synthetase 1
  Uniprot ID: Q8NFF5
  ENSP ID: ENSP00000317296
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 32280 - protein, 128 aa, Homo sapiens
  Payload ID: 6322
  Gene Symbol: FLAD1
  Gene Name: flavin adenine dinucleotide synthetase 1
  ENSP ID: ENSP00000357413
MLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 32281 - protein, 294 aa, Homo sapiens
  Payload ID: 6322
  Gene Symbol: FLAD1
  Gene Name: flavin adenine dinucleotide synthetase 1
  Uniprot ID: Q8NFF5
  ENSP ID: ENSP00000357416
MQPSSSTPPLHPYSTDGLIFPFNPQGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGRDLMEEGHYAQSHWWHPRSQ

SEQ ID NO: 32282 - protein, 446 aa, Homo sapiens
  Payload ID: 6322
  Gene Symbol: FLAD1
  Gene Name: flavin adenine dinucleotide synthetase 1
  Uniprot ID: Q8NFF5
  ENSP ID: ENSP00000357417
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRG

SEQ ID NO: 32283 - protein, 456 aa, Homo sapiens
  Payload ID: 6322
  Gene Symbol: FLAD1
  Gene Name: flavin adenine dinucleotide synthetase 1
  ENSP ID: ENSP00000357418
MGWDLGTRLFQRQEQRSRLSRIWLEKTRVFLEGSTRTPALPHCLFWLLQVPSTQDPLFPGYGPQCPVDLAGPPCLRPLFGGLGGYWRALQRGREGRTMTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRY

SEQ ID NO: 32284 - protein, 532 aa, Homo sapiens
  Payload ID: 6323
  Gene Symbol: FMO1
  Gene Name: flavin containing monooxygenase 1
  Uniprot ID: Q01740
  ENSP ID: ENSP00000346901
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 32285 - protein, 532 aa, Homo sapiens; identical to SEQ ID NO: 32284
  Payload ID: 6323
  Gene Symbol: FMO1
  Gene Name: flavin containing monooxygenase 1
  Uniprot ID: Q01740
  ENSP ID: ENSP00000356724

SEQ ID NO: 32286 - protein, 469 aa, Homo sapiens
  Payload ID: 6323
  Gene Symbol: FMO1
  Gene Name: flavin containing monooxygenase 1
  Uniprot ID: Q01740
  ENSP ID: ENSP00000385543
MAKRVAIVGAGVSGLASIKCCLEEGLEPTCFERSDDLGGLWRFTTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 32287 - protein, 208 aa, Homo sapiens
  Payload ID: 6323
  Gene Symbol: FMO1
  Gene Name: flavin containing monooxygenase 1
  ENSP ID: ENSP00000406982
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAE

SEQ ID NO: 32288 - protein, 532 aa, Homo sapiens; identical to SEQ ID NO: 32284
  Payload ID: 6323
  Gene Symbol: FMO1
  Gene Name: flavin containing monooxygenase 1
  Uniprot ID: Q01740
  ENSP ID: ENSP00000481732

SEQ ID NO: 32289 - protein, 535 aa, Homo sapiens [sequence omitted]

SEQ ID NO: 32290 - protein, 153 aa, Homo sapiens
  Payload ID: 6324
  Gene Symbol: FMO2
  Gene Name: flavin containing monooxygenase 2 (non-functional)
  ENSP ID: ENSP00000487002
TQPREKTILSKRRCQKAKTKENVEDGRASIYQSVVTNTSKEMSCFSDFPMPEDFPNFLHNSKLLEYFRIFAKKFDLLKYIQFQTTVLSVRKCPDFSSSGQWKVVTQSNGKEQSAVFDAVMVCSGHHILPHIPLKSFPGFYQHQAWHLGHEPYL

SEQ ID NO: 32291 - protein, 131 aa, Homo sapiens
  Payload ID: 6324
  Gene Symbol: FMO2
  Gene Name: flavin containing monooxygenase 2 (non-functional)
  ENSP ID: ENSP00000487216
MAKKVAVIGAGVSGLISLKCCVDEGLEPTCFERTEDIGGVWRFKENVEDGRASIYQSVVTNTSKEMSCFSDFPMPEDFPNFLHNSKLLEYFRIFAKKFDLLKYIQFQTTVLSVRKCPDFSSSGQWKVVTQS

SEQ ID NO: 32292 - protein, 532 aa, Homo sapiens
  Payload ID: 6325
  Gene Symbol: FMO3
  Gene Name: flavin containing monooxygenase 3
  Uniprot ID: P31513
  ENSP ID: ENSP00000356729
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 32293 - protein, 48 aa, Homo sapiens
  Payload ID: 6325
  Gene Symbol: FMO3
  Gene Name: flavin containing monooxygenase 3
  ENSP ID: ENSP00000476963
MGKKVAIIGAGVSGLASIRSCLEEGLEPTCFEKSNDIGGLWKFSRSHE

SEQ ID NO: 32294 - protein, 218 aa, Homo sapiens
  Payload ID: 6325
  Gene Symbol: FMO3
  Gene Name: flavin containing monooxygenase 3
  ENSP ID: ENSP00000477451
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPDYKEPGVFNGKRVLVVGLGNSGCDIATELSRTAEQVMISSRSGSWVMSRVWDNGYPWDMLLV

SEQ ID NO: 32295 - protein, 558 aa, Homo sapiens
  Payload ID: 6326
  Gene Symbol: FMO4
  Gene Name: flavin containing monooxygenase 4
  Uniprot ID: P31512
  ENSP ID: ENSP00000356723
MAKKVAVIGAGVSGLSSIKCCVDEDLEPTCFERSDDIGGLWKFTESSKDGMTRVYKSLVTNVCKEMSCYSDFPFHEDYPNFMNHEKFWDYLQEFAEHFDLLKYIQFKTTVCSITKRPDFSETGQWDVVTETEGKQNRAVFDAVMVCTGHFLNPHLPLEAFPGIHKFKGQILHSQEYKIPEGFQGKRVLVIGLGNTGGDIAVELSRTAAQVLLSTRTGTWVLGRSSDWGYPYNMMVTRRCCSFIAQVLPSRFLNWIQERKLNKRFNHEDYGLSITKGKKAKFIVNDELPNCILCGAITMKTSVIEFTETSAVFEDGTVEENIDVVIFTTGYTFSFPFFEEPLKSLCTKKIFLYKQVFPLNLERATLAIIGLIGLKGSILSGTELQARWVTRVFKGLCKIPPSQKLMMEATEKEQLIKRGVFKDTSKDKFDYIAYMDDIAACIGTKPSIPLLFLKDPRLAWEVFFGPCTPYQYRLMGPGKWDGARNAILTQWDRTLKPLKTRIVPDSSKPASMSHYLKAWGAPVLLASLLLICKSSLFLKLVRDKLQDRMSPYLVSLWRG

SEQ ID NO: 32296 - protein, 533 aa, Homo sapiens
  Payload ID: 6327
  Gene Symbol: FMO5
  Gene Name: flavin containing monooxygenase 5
  Uniprot ID: P49326
  ENSP ID: ENSP00000254090
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARKAILTTDDRIRKPLMTRVVERSSSMTSTMTIGKFMLALAFFAIIIAYF

SEQ ID NO: 32297 - protein, 285 aa, Homo sapiens
  Payload ID: 6327
  Gene Symbol: FMO5
  Gene Name: flavin containing monooxygenase 5
  Uniprot ID: P49326
  ENSP ID: ENSP00000358277
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRSKDIALTE

SEQ ID NO: 32298 - protein, 464 aa, Homo sapiens
  Payload ID: 6327
  Gene Symbol: FMO5
  Gene Name: flavin containing monooxygenase 5
  Uniprot ID: P49326
  ENSP ID: ENSP00000416011
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKSLTMRKTSDKPKLKNILQIPDYLKTVKIINKESLRNCPGIKGPKET

SEQ ID NO: 32299 - protein, 145 aa, Homo sapiens
  Payload ID: 6327
  Gene Symbol: FMO5
  Gene Name: flavin containing monooxygenase 5
  ENSP ID: ENSP00000432569
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVM

SEQ ID NO: 32300 - protein, 278 aa, Homo sapiens
  Payload ID: 6327
  Gene Symbol: FMO5
  Gene Name: flavin containing monooxygenase 5
  ENSP ID: ENSP00000433742
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRL

SEQ ID NO: 32301 - protein, 192 aa, Homo sapiens
  Payload ID: 6327
  Gene Symbol: FMO5
  Gene Name: flavin containing monooxygenase 5
  ENSP ID: ENSP00000436429
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIG

SEQ ID NO: 32302 - protein, 464 aa, Homo sapiens; identical to SEQ ID NO: 32298
  Payload ID: 6327
  Gene Symbol: FMO5
  Gene Name: flavin containing monooxygenase 5
  Uniprot ID: P49326
  ENSP ID: ENSP00000462062

SEQ ID NO: 32303 - protein, 386 aa, Homo sapiens
  Payload ID: 6328
  Gene Symbol: FLI1
  Gene Name: Fli-1 proto-oncogene, ETS transcription factor
  Uniprot ID: Q01543
  ENSP ID: ENSP00000281428
MEGGLAGERARESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 32304 - protein, 259 aa, Homo sapiens
  Payload ID: 6328
  Gene Symbol: FLI1
  Gene Name: Fli-1 proto-oncogene, ETS transcription factor
  Uniprot ID: Q01543
  ENSP ID: ENSP00000339627
MDPGSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 32305 - protein, 82 aa, Homo sapiens
  Payload ID: 6328
  Gene Symbol: FLI1
  Gene Name: Fli-1 proto-oncogene, ETS transcription factor
  ENSP ID: ENSP00000399985
MDGTIKEALSVVSDDQSLFDSAYGAAAHLPKADMTASGSPDYGQPHKINPLPPQQEWINQPVRVNVKREYDHMNGSRRQLPH

SEQ ID NO: 32306 - protein, 419 aa, Homo sapiens
  Payload ID: 6328
  Gene Symbol: FLI1
  Gene Name: Fli-1 proto-oncogene, ETS transcription factor
  Uniprot ID: Q01543
  ENSP ID: ENSP00000432950
MTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 32307 - protein, 452 aa, Homo sapiens
  Payload ID: 6328
  Gene Symbol: FLI1
  Gene Name: Fli-1 proto-oncogene, ETS transcription factor
  Uniprot ID: Q01543
  ENSP ID: ENSP00000433488
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 32308 - protein, 106 aa, Homo sapiens
  Payload ID: 6328
  Gene Symbol: FLI1
  Gene Name: Fli-1 proto-oncogene, ETS transcription factor
  ENSP ID: ENSP00000476428
MTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVR

SEQ ID NO: 32309 - protein, 49 aa, Homo sapiens
  Payload ID: 6328
  Gene Symbol: FLI1
  Gene Name: Fli-1 proto-oncogene, ETS transcription factor
  ENSP ID: ENSP00000477262
MTASGSPDYGQPHKINPLPPQQEWINQPVRVNVKREYDHMNGSRFTAGL

SEQ ID NO: 32310 - protein, 1269 aa, Homo sapiens
  Payload ID: 6329
  Gene Symbol: FLII
  Gene Name: flightless I actin binding protein
  Uniprot ID: Q13045
  ENSP ID: ENSP00000324573
MEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 32311 - protein, 1214 aa, Homo sapiens
  Payload ID: 6329
  Gene Symbol: FLII
  Gene Name: flightless I actin binding protein
  Uniprot ID: Q13045
  ENSP ID: ENSP00000438536
MEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 32312 - protein, 51 aa, Homo sapiens
  Payload ID: 6329
  Gene Symbol: FLII
  Gene Name: flightless I actin binding protein
  ENSP ID: ENSP00000462293
MEATGVLPFVRGVDLSGNDFKMVRVGSVAPQRLPWAGGAIEGGEQGLCASP

SEQ ID NO: 32313 - protein, 700 aa, Homo sapiens
  Payload ID: 6329
  Gene Symbol: FLII
  Gene Name: flightless I actin binding protein
  ENSP ID: ENSP00000462314
MEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRNMSGRAGCAWSARAMSSTPLPAASTPGAPSARPWPKTGWHSPRLGEEEEGASSTVC

SEQ ID NO: 32314 - protein, 29 aa, Homo sapiens
  Payload ID: 6329
  Gene Symbol: FLII
  Gene Name: flightless I actin binding protein
  ENSP ID: ENSP00000462797
PPQMRRLVHLQTLVLNGNPLLHAQLRSQR

SEQ ID NO: 32315 - protein, 1258 aa, Homo sapiens
  Payload ID: 6329
  Gene Symbol: FLII
  Gene Name: flightless I actin binding protein
  Uniprot ID: Q13045
  ENSP ID: ENSP00000463534
MDLRGLRPVPGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 32316 - protein, 185 aa, Homo sapiens
  Payload ID: 6329
  Gene Symbol: FLII
  Gene Name: flightless I actin binding protein
  ENSP ID: ENSP00000463675
NLTDLLYLDLSENRLESLPPQMRRLVHLQTLVLNGNPLLHAQLRQLPAMTALQTLHLRSTQRTQSNLPTSLEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQV

SEQ ID NO: 32317 - protein, 279 aa, Homo sapiens
  Payload ID: 6329
  Gene Symbol: FLII
  Gene Name: flightless I actin binding protein
  ENSP ID: ENSP00000463838
PDDIFKLDDLSVLDLSHNQLTECPRELENAKNMLVLNLSHNSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSL

SEQ ID NO: 32318 - protein, 117 aa, Homo sapiens
  Payload ID: 6329
  Gene Symbol: FLII
  Gene Name: flightless I actin binding protein
  ENSP ID: ENSP00000463902
LDLSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDHQPFAS

SEQ ID NO: 32319 - protein, 23 aa, Homo sapiens
  Payload ID: 6329
  Gene Symbol: FLII
  Gene Name: flightless I actin binding protein
  ENSP ID: ENSP00000465202
  MOD_RES (1)..(1): Any amino acid
XNTMFDTSYSKQVLQREGLLCSD

SEQ ID NO: 32320 - protein, 133 aa, Homo sapiens
  Payload ID: 6329
  Gene Symbol: FLII
  Gene Name: flightless I actin binding protein
  ENSP ID: ENSP00000467199
MTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLE

SEQ ID NO: 32321 - protein, 99 aa, Homo sapiens
  Payload ID: 6329
  Gene Symbol: FLII
  Gene Name: flightless I actin binding protein
  ENSP ID: ENSP00000467212
MTSLRWLKLNRTGLCYLPEELAALQKLEHLSVSHNNLTTLHGELSSLPSLRAIVARANSLKNSGVPDDIFKLDDLSVLDLSHNQLTECPRELENAKNML

SEQ ID NO: 32322 - protein, 207 aa, Homo sapiens
  Payload ID: 6329
  Gene Symbol: FLII
  Gene Name: flightless I actin binding protein
  ENSP ID: ENSP00000468045
VPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVIWVEGGPRWACGQGRVITQGSLSPCQVYIQHMRSKEHERPRRLRLVRKGNEQHAFTRCFHAWSAFCKALA

SEQ ID NO: 32323 - protein, 51 aa, Homo sapiens; identical to SEQ ID NO: 32312
  Payload ID: 6329
  Gene Symbol: FLII
  Gene Name: flightless I actin binding protein
  ENSP ID: ENSP00000486754

SEQ ID NO: 32324 - protein, 427 aa, Homo sapiens
  Payload ID: 6330
  Gene Symbol: FLOT1
  Gene Name: flotillin 1
  Uniprot ID: O75955
  ENSP ID: ENSP00000365569
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 32325 - protein, 427 aa, Homo sapiens; identical to SEQ ID NO: 32324
  Payload ID: 6330
  Gene Symbol: FLOT1
  Gene Name: flotillin 1
  Uniprot ID: O75955
  ENSP ID: ENSP00000372873

SEQ ID NO: 32326 - protein, 427 aa, Homo sapiens; identical to SEQ ID NO: 32324
  Payload ID: 6330
  Gene Symbol: FLOT1
  Gene Name: flotillin 1
  Uniprot ID: O75955
  ENSP ID: ENSP00000373056

SEQ ID NO: 32327 - protein, 238 aa, Homo sapiens
  Payload ID: 6330
  Gene Symbol: FLOT1
  Gene Name: flotillin 1
  ENSP ID: ENSP00000388032
MRPWWSPVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAE

SEQ ID NO: 32328 - protein, 60 aa, Homo sapiens
  Payload ID: 6330
  Gene Symbol: FLOT1
  Gene Name: flotillin 1
  ENSP ID: ENSP00000388104
VAKTKQQIEEQRVQVQVVERAQQVAVQEQEIARREKELEARVRKPAEAERYKLERLAEAE

SEQ ID NO: 32329 - protein, 82 aa, Homo sapiens
  Payload ID: 6330
  Gene Symbol: FLOT1
  Gene Name: flotillin 1
  ENSP ID: ENSP00000388153
DYLHSLGKARTAQVQKDARIGEAEAKRDAGIREAKAKQEKVSAQYLSEIEMAKAQRDYELKKAAYDIEVNTRRAQADLAYQL

SEQ ID NO: 32330 - protein, 147 aa, Homo sapiens
  Payload ID: 6330
  Gene Symbol: FLOT1
  Gene Name: flotillin 1
  ENSP ID: ENSP00000388517
MRPWWSPVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMA

SEQ ID NO: 32331 - protein, 427 aa, Homo sapiens; identical to SEQ ID NO: 32324
  Payload ID: 6330
  Gene Symbol: FLOT1
  Gene Name: flotillin 1
  Uniprot ID: O75955
  ENSP ID: ENSP00000388861

SEQ ID NO: 32332 - protein, 192 aa, Homo sapiens
  Payload ID: 6330
  Gene Symbol: FLOT1
  Gene Name: flotillin 1
  ENSP ID: ENSP00000389138
MFFTCGPNEAMVVSGFCRSPPVMVAGGRVFVLPCIQQIQRISLNTLTLNVKSEKVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIE

SEQ ID NO: 32333 - protein, 145 aa, Homo sapiens
  Payload ID: 6330
  Gene Symbol: FLOT1
  Gene Name: flotillin 1
  ENSP ID: ENSP00000389698
MGVEGTGRGGCRLGGPDGKGKGWAPVDATARLPHPQRLSLPLLQLQPEPCFSLVAQMRPWWSPDYLHSLGKARTAQVQKDARIGEAEAKRDAGIREAKAKQEKVSAQYLSEIEMAKAQRDYELKKAAYDIEVNTRRAQADLAYQL

SEQ ID NO: 32334 - protein, 185 aa, Homo sapiens
  Payload ID: 6330
  Gene Symbol: FLOT1
  Gene Name: flotillin 1
  ENSP ID: ENSP00000390747
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKR

SEQ ID NO: 32335 - protein, 210 aa, Homo sapiens
  Payload ID: 6330
  Gene Symbol: FLOT1
  Gene Name: flotillin 1
  ENSP ID: ENSP00000390909
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMA

SEQ ID NO: 32336 - protein, 235 aa, Homo sapiens
  Payload ID: 6330
  Gene Symbol: FLOT1
  Gene Name: flotillin 1
  ENSP ID: ENSP00000390961
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQAD

SEQ ID NO: 32337 - protein, 185 aa, Homo sapiens; identical to SEQ ID NO: 32334
  Payload ID: 6330
  Gene Symbol: FLOT1
  Gene Name: flotillin 1
  ENSP ID: ENSP00000391341

SEQ ID NO: 32338 - protein, 427 aa, Homo sapiens; identical to SEQ ID NO: 32324
  Payload ID: 6330
  Gene Symbol: FLOT1
  Gene Name: flotillin 1
  Uniprot ID: O75955
  ENSP ID: ENSP00000391438

SEQ ID NO: 32339 - protein, 192 aa, Homo sapiens; identical to SEQ ID NO: 32332
  Payload ID: 6330
  Gene Symbol: FLOT1
  Gene Name: flotillin 1
  ENSP ID: ENSP00000391633

SEQ ID NO: 32340 - protein, 192 aa, Homo sapiens; identical to SEQ ID NO: 32332
  Payload ID: 6330
  Gene Symbol: FLOT1
  Gene Name: flotillin 1
  ENSP ID: ENSP00000392683

SEQ ID NO: 32341 - protein, 182 aa, Homo sapiens
  Payload ID: 6330
  Gene Symbol: FLOT1
  Gene Name: flotillin 1
  ENSP ID: ENSP00000392736
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQ

SEQ ID NO: 32342 - protein, 138 aa, Homo sapiens
  Payload ID: 6330
  Gene Symbol: FLOT1
  Gene Name: flotillin 1
  ENSP ID: ENSP00000393145
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIE

SEQ ID NO: 32343 - protein, 252 aa, Homo sapiens
  Payload ID: 6330
  Gene Symbol: FLOT1
  Gene Name: flotillin 1
  ENSP ID: ENSP00000393409
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQ

SEQ ID NO: 32344 - protein, 252 aa, Homo sapiens; identical to SEQ ID NO: 32343
  Payload ID: 6330
  Gene Symbol: FLOT1
  Gene Name: flotillin 1
  ENSP ID: ENSP00000393741

SEQ ID NO: 32345 - protein, 90 aa, Homo sapiens
  Payload ID: 6330
  Gene Symbol: FLOT1
  Gene Name: flotillin 1
  ENSP ID: ENSP00000393767
  MOD_RES (1)..(1): Any amino acid
XAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 32346 - protein, 238 aa, Homo sapiens; identical to SEQ ID NO: 32327
  Payload ID: 6330
  Gene Symbol: FLOT1
  Gene Name: flotillin 1
  ENSP ID: ENSP00000395333

SEQ ID NO: 32347 - protein, 235 aa, Homo sapiens; identical to SEQ ID NO: 32336
  Payload ID: 6330
  Gene Symbol: FLOT1
  Gene Name: flotillin 1
  ENSP ID: ENSP00000395732

SEQ ID NO: 32348 - protein, 238 aa, Homo sapiens; identical to SEQ ID NO: 32327
  Payload ID: 6330
  Gene Symbol: FLOT1
  Gene Name: flotillin 1
  ENSP ID: ENSP00000395846

SEQ ID NO: 32349 - protein, 192 aa, Homo sapiens; identical to SEQ ID NO: 32332
  Payload ID: 6330
  Gene Symbol: FLOT1
  Gene Name: flotillin 1
  ENSP ID: ENSP00000396247

SEQ ID NO: 32350 - protein, 115 aa, Homo sapiens
  Payload ID: 6330
  Gene Symbol: FLOT1
  Gene Name: flotillin 1
  ENSP ID: ENSP00000397108
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKR

SEQ ID NO: 32351 - protein, 235 aa, Homo sapiens; identical to SEQ ID NO: 32336
  Payload ID: 6330
  Gene Symbol: FLOT1
  Gene Name: flotillin 1
  ENSP ID: ENSP00000398834

SEQ ID NO: 32352 - protein, 165 aa, Homo sapiens
  Payload ID: 6330
  Gene Symbol: FLOT1
  Gene Name: flotillin 1
  ENSP ID: ENSP00000398866
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQAD

SEQ ID NO: 32353 - protein, 185 aa, Homo sapiens; identical to SEQ ID NO: 32334
  Payload ID: 6330
  Gene Symbol: FLOT1
  Gene Name: flotillin 1
  ENSP ID: ENSP00000399313

SEQ ID NO: 32354 - protein, 252 aa, Homo sapiens; identical to SEQ ID NO: 32343
  Payload ID: 6330
  Gene Symbol: FLOT1
  Gene Name: flotillin 1
  ENSP ID: ENSP00000400615

SEQ ID NO: 32355 - protein, 185 aa, Homo sapiens; identical to SEQ ID NO: 32334
  Payload ID: 6330
  Gene Symbol: FLOT1
  Gene Name: flotillin 1
  ENSP ID: ENSP00000403273

SEQ ID NO: 32356 - protein, 11 aa, Homo sapiens
  Payload ID: 6330
  Gene Symbol: FLOT1
  Gene Name: flotillin 1
  ENSP ID: ENSP00000403574
VAKTKQQIEEQ

SEQ ID NO: 32357 - protein, 235 aa, Homo sapiens; identical to SEQ ID NO: 32336
  Payload ID: 6330
  Gene Symbol: FLOT1
  Gene Name: flotillin 1
  ENSP ID: ENSP00000403627

SEQ ID NO: 32358 - protein, 210 aa, Homo sapiens; identical to SEQ ID NO: 32335
  Payload ID: 6330
  Gene Symbol: FLOT1
  Gene Name: flotillin 1
  ENSP ID: ENSP00000403917

SEQ ID NO: 32359 - protein, 145 aa, Homo sapiens; identical to SEQ ID NO: 32333
  Payload ID: 6330
  Gene Symbol: FLOT1
  Gene Name: flotillin 1
  ENSP ID: ENSP00000404300

SEQ ID NO: 32360 - protein, 115 aa, Homo sapiens
  Payload ID: 6330
  Gene Symbol: FLOT1
  Gene Name: flotillin 1
  ENSP ID: ENSP00000407101
MGVEGTGRGGCRLGGPDGKGKGWAPVDATARLPHPQRLSLPLLQLQPEPCFSLVAQMRPWWSPDYLHSLGKARTAQVQKDARIGEAEAKRDAGIREAKAKQEKVSAQYLSEIEMA

SEQ ID NO: 32361 - protein, 192 aa, Homo sapiens; identical to SEQ ID NO: 32332
  Payload ID: 6330
  Gene Symbol: FLOT1
  Gene Name: flotillin 1
  ENSP ID: ENSP00000407122

SEQ ID NO: 32362 - protein, 185 aa, Homo sapiens; identical to SEQ ID NO: 32334
  Payload ID: 6330
  Gene Symbol: FLOT1
  Gene Name: flotillin 1
  ENSP ID: ENSP00000409375

SEQ ID NO: 32363 - protein, 210 aa, Homo sapiens; identical to SEQ ID NO: 32335
  Payload ID: 6330
  Gene Symbol: FLOT1
  Gene Name: flotillin 1
  ENSP ID: ENSP00000409995

SEQ ID NO: 32364 - protein, 145 aa, Homo sapiens; identical to SEQ ID NO: 32333
  Payload ID: 6330
  Gene Symbol: FLOT1
  Gene Name: flotillin 1
  ENSP ID: ENSP00000410255

SEQ ID NO: 32365 - protein, 357 aa, Homo sapiens
  Payload ID: 6330
  Gene Symbol: FLOT1
  Gene Name: flotillin 1
  ENSP ID: ENSP00000410658
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 32366 - protein, 252 aa, Homo sapiens; identical to SEQ ID NO: 32343
  Payload ID: 6330
  Gene Symbol: FLOT1
  Gene Name: flotillin 1
  ENSP ID: ENSP00000411030

SEQ ID NO: 32367 - protein, 192 aa, Homo sapiens; identical to SEQ ID NO: 32332
  Payload ID: 6330
  Gene Symbol: FLOT1
  Gene Name: flotillin 1
  ENSP ID: ENSP00000412058

SEQ ID NO: 32368 - protein, 185 aa, Homo sapiens; identical to SEQ ID NO: 32334
  Payload ID: 6330
  Gene Symbol: FLOT1
  Gene Name: flotillin 1
  ENSP ID: ENSP00000412484

SEQ ID NO: 32369 - protein, 235 aa, Homo sapiens; identical to SEQ ID NO: 32336
  Payload ID: 6330
  Gene Symbol: FLOT1
  Gene Name: flotillin 1
  ENSP ID: ENSP00000413293

SEQ ID NO: 32370 - protein, 145 aa, Homo sapiens; identical to SEQ ID NO: 32333
  Payload ID: 6330
  Gene Symbol: FLOT1
  Gene Name: flotillin 1
  ENSP ID: ENSP00000414435

SEQ ID NO: 32371 - protein, 238 aa, Homo sapiens; identical to SEQ ID NO: 32327
  Payload ID: 6330
  Gene Symbol: FLOT1
  Gene Name: flotillin 1
  ENSP ID: ENSP00000415094

SEQ ID NO: 32372 - protein, 231 aa, Homo sapiens
  Payload ID: 6330
  Gene Symbol: FLOT1
  Gene Name: flotillin 1
  ENSP ID: ENSP00000415104
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAE

SEQ ID NO: 32373 - protein, 186 aa, Homo sapiens
  Payload ID: 6330
  Gene Symbol: FLOT1
  Gene Name: flotillin 1
  ENSP ID: ENSP00000415215
VAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 32374 - protein, 145 aa, Homo sapiens; identical to SEQ ID NO: 32333
  Payload ID: 6330
  Gene Symbol: FLOT1
  Gene Name: flotillin 1
  ENSP ID: ENSP00000416243

SEQ ID NO: 32375 - protein, 238 aa, Homo sapiens; identical to SEQ ID NO: 32327
  Payload ID: 6330
  Gene Symbol: FLOT1
  Gene Name: flotillin 1
  ENSP ID: ENSP00000416355

SEQ ID NO: 32376 - protein, 252 aa, Homo sapiens; identical to SEQ ID NO: 32343
  Payload ID: 6330
  Gene Symbol: FLOT1
  Gene Name: flotillin 1
  ENSP ID: ENSP00000416413

SEQ ID NO: 32377 - protein, 483 aa, Homo sapiens
  Payload ID: 6331
  Gene Symbol: FLOT2
  Gene Name: flotillin 2
  ENSP ID: ENSP00000378366
MGNCHTVGPNEALVVSGGCCGSDYKQYVFGGWAWAWWCISDTQRLSLEVMTILCRCENIETSEGVPLFVTGVAQVPCPCLLDCKWGNSKGFWKLCQVCQISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 32378 - protein, 428 aa, Homo sapiens
  Payload ID: 6331
  Gene Symbol: FLOT2
  Gene Name: flotillin 2
  Uniprot ID: Q14254
  ENSP ID: ENSP00000378368
MGNCHTVGPNEALVVSGGCCGSDYKQYVFGGWAWAWWCISDTQRISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 32379 - protein, 118 aa, Homo sapiens
  Payload ID: 6331
  Gene Symbol: FLOT2
  Gene Name: flotillin 2
  ENSP ID: ENSP00000463304
MGNCHTVGPNEALVVSGGCCGSDYKQYVFGGWAWAWWCISDTQRLSLEVMTILCRCENIETSEGVPLFVTGVAQDFPRDYDVAAPLRGRRDGRGGSFNCDGCRPGEDHDGEGTPGRGL

SEQ ID NO: 32380 - protein, 428 aa, Homo sapiens
  Payload ID: 6331
  Gene Symbol: FLOT2
  Gene Name: flotillin 2
  ENSP ID: ENSP00000463503
MGNCHTVGPNEALVVSGGCCGSDYKQYVFGGWAWAWWCISDTQRLSLEVMTILCRCENIETSEGVPLFVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 32381 - protein, 68 aa, Homo sapiens
  Payload ID: 6331
  Gene Symbol: FLOT2
  Gene Name: flotillin 2
  ENSP ID: ENSP00000465022
MGNCHTVGPNEALVVSGGCCGSDYKQYVFGGWAWAWWCISDTQRDPDSGADLSGPGPVCQAGAGGGSP

SEQ ID NO: 32382 - protein, 249 aa, Homo sapiens
  Payload ID: 6331
  Gene Symbol: FLOT2
  Gene Name: flotillin 2
  ENSP ID: ENSP00000465819
  MOD_RES (1)..(1): Any amino acid
XLSLEVMTILCRCENIETSEGVPLFVTGVAQVKIMTEKELLAVACEQFLGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAE

SEQ ID NO: 32383 - protein, 496 aa, Homo sapiens
  Payload ID: 6332
  Gene Symbol: FIZ1
  Gene Name: FLT3-interacting zinc finger 1
  Uniprot ID: Q96SL8
  ENSP ID: ENSP00000221665
MDDVPAPTPAPAPPAAAAPRVPFHCSECGKSFRYRSDLRRHFARHTALKPHACPRCGKGFKHSFNLANHLRSHTGERPYRCSACPKGFRDSTGLLHHQVVHTGEKPYCCLVCELRFSSRSSLGRHLKRQHRGVLPSPLQPGPGLPALSAPCSVCCNVGPCSVCGGSGAGGGEGPEGAGAGLGSWGLAEAAAAAAASLPPFACGACARRFDHGRELAAHWAAHTDVKPFKCPRCERDFNAPALLERHKLTHDLQGPGAPPAQAWAAGPGAGPETAGEGTAAEAGDAPLASDRRLLLGPAGGGVPKLGGLLPEGGGEAPAPAAAAEPSEDTLYQCDCGTFFASAAALASHLEAHSGPATYGCGHCGALYAALAALEEHRRVSHGEGGGEEAATAAREREPASGEPPSGSGRGKKIFGCSECEKLFRSPRDLERHVLVHTGEKPFPCLECGKFFRHECYLKRHRLLHGTERPFPCHICGKGFITLSNLSRHLKLHRGMD

SEQ ID NO: 32384 - protein, 193 aa, Homo sapiens
  Payload ID: 6332
  Gene Symbol: FIZ1
  Gene Name: FLT3-interacting zinc finger 1
  ENSP ID: ENSP00000465131
MDDVPAPTPAPAPPAAAAPRVPFHCSECGKSFRYRSDLRRHFARHTALKPHACPRCGKGFKHSFNLANHLRSHTGERPYRCSACPKGFRDSTGLLHHQVVHTGEKPYCCLVCELRFSSRSSLGRHLKRQHRGVLPSPLQPGPGLPALSAPCSVCCNVGPCSVCGGSGAGGGEGPEGAGAGLGSWGLAEAAAAA

SEQ ID NO: 32385 - protein, 44 aa, Homo sapiens
  Payload ID: 6332
  Gene Symbol: FIZ1
  Gene Name: FLT3-interacting zinc finger 1
  ENSP ID: ENSP00000468018
MDDVPAPTPAPAPPAAAAPRVPFHCSECGKSFRYRSDLRRHFAR

SEQ ID NO: 32386 - protein, 134 aa, Homo sapiens
  Payload ID: 6332
  Gene Symbol: FIZ1
  Gene Name: FLT3-interacting zinc finger 1
  ENSP ID: ENSP00000468342
  MOD_RES (1)..(1): Any amino acid
XPAPAPPAAAAPRVPFHCSECGKSFRYRSDLRRHFARHTALKPHACPRCGKGFKHSFNLANHLRSHTGERPYRCSACPKGFRDSTGLLHHQEAKQALEELEEGQCDWSMEKQKVWLRRSLESAGPWKYSCRPHW

SEQ ID NO: 32387 - protein, 68 aa, Homo sapiens
  Payload ID: 6332
  Gene Symbol: FIZ1
  Gene Name: FLT3-interacting zinc finger 1
  ENSP ID: ENSP00000468529
MDDVPAPTPAPAPPAAAAPRVPFHCSECGKSFRYRSDLRRHFARHTALNASTVGFSPLPCSPALACPP

SEQ ID NO: 32388 - protein, 140 aa, Homo sapiens
  Payload ID: 6333
  Gene Symbol: FLYWCH2
  Gene Name: FLYWCH family member 2
  Uniprot ID: Q96CP2
  ENSP ID: ENSP00000293981
MPLPEPSEQEGESVKASQEPSPKPGTEVIPAAPRKPRKFSKLVLLTASKDSTKVAGAKRKGVHCVMSLGVPGPATLAKALLQTHPEAQRAIEAAPQEPEQKRSRQDPGTDRTEDSGLAAGPPEAAGENFAPCSVAPGKSL

SEQ ID NO: 32389 - protein, 140 aa, Homo sapiens; identical to SEQ ID NO: 32388
  Payload ID: 6333
  Gene Symbol: FLYWCH2
  Gene Name: FLYWCH family member 2
  Uniprot ID: Q96CP2
  ENSP ID: ENSP00000380159

SEQ ID NO: 32390 - protein, 144 aa, Homo sapiens
  Payload ID: 6333
  Gene Symbol: FLYWCH2
  Gene Name: FLYWCH family member 2
  ENSP ID: ENSP00000459223
MPLPEPSEQEGESVKASQEPSPKPGTEVIPAAPRKPRKFSKLVLLTASKDSTKVAGAKRKGVHCVMSLGVPGPATLAKALLQTHPEAQRAIEAAPQEPEQKRSRQDPGEAPQRPPRTARHLPGWPPQPRWLHQALLPGMRVLVP

SEQ ID NO: 32391 - protein, 91 aa, Homo sapiens
  Payload ID: 6333
  Gene Symbol: FLYWCH2
  Gene Name: FLYWCH family member 2
  ENSP ID: ENSP00000461275
MPLPEPSEQEGESVKASQEPSPKPGTEVIPAAPRKPRKFSKLVLLTASKDSTKVAGAKRKGVHCVMSLGVPGPATLAKALLQTHPEAQRAI

SEQ ID NO: 32392 - protein, 716 aa, Homo sapiens
  Payload ID: 6334
  Gene Symbol: FLYWCH1
  Gene Name: FLYWCH-type zinc finger 1
  Uniprot ID: Q4VC44
  ENSP ID: ENSP00000253928
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 32393 - protein, 494 aa, Homo sapiens
  Payload ID: 6334
  Gene Symbol: FLYWCH1
  Gene Name: FLYWCH-type zinc finger 1
  ENSP ID: ENSP00000344122
  MOD_RES (1)..(1): Any amino acid
XFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGAGLSFQWLFRILQLLGHAPVLLCPSGSSCLPSLPAPHGPCPALSIPLEGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 32394 - protein, 715 aa, Homo sapiens
  Payload ID: 6334
  Gene Symbol: FLYWCH1
  Gene Name: FLYWCH-type zinc finger 1
  Uniprot ID: Q4VC44
  ENSP ID: ENSP00000399938
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 32395 - protein, 47 aa, Homo sapiens
  Payload ID: 6334
  Gene Symbol: FLYWCH1
  Gene Name: FLYWCH-type zinc finger 1
  ENSP ID: ENSP00000458282
MPLPEPSEQEGESVKAGQEPSPKPGTDVIPAAPRKPREFSKLVLLTA

SEQ ID NO: 32396 - protein, 467 aa, Homo sapiens
  Payload ID: 6334
  Gene Symbol: FLYWCH1
  Gene Name: FLYWCH-type zinc finger 1
  ENSP ID: ENSP00000458661
  MOD_RES (1)..(1): Any amino acid
XPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYG

SEQ ID NO: 32397 - protein, 78 aa, Homo sapiens
  Payload ID: 6334
  Gene Symbol: FLYWCH1
  Gene Name: FLYWCH-type zinc finger 1
  ENSP ID: ENSP00000458689
  MOD_RES (1)..(1): Any amino acid
XQARLGCRSRAITQGHRIMVMRSHCHQPDLAGLEALRQRERLPTTAQQEDPEKIQVQLCFKTCSPESQQIYGKSQPLV

SEQ ID NO: 32398 - protein, 77 aa, Homo sapiens
  Payload ID: 6334
  Gene Symbol: FLYWCH1
  Gene Name: FLYWCH-type zinc finger 1
  ENSP ID: ENSP00000459326
MPLPEPSEQEGESVKAGQEPSPKPGTDVIPAAPRKPREFSKLVLLTASDQDEDGVGSKPQEVHCVLSLEMAGPATLA

SEQ ID NO: 32399 - protein, 93 aa, Homo sapiens
  Payload ID: 6334
  Gene Symbol: FLYWCH1
  Gene Name: FLYWCH-type zinc finger 1
  ENSP ID: ENSP00000459480
  MOD_RES (1)..(1): Any amino acid
XALRQRERLPTTAQQEDPEKIQVQLCFKTCSPESQQIYGDIKDVRLDASMVFASPQEVSQEEFLDGVLMSAENSAQSWRLQTQLSWGRAVAPS

SEQ ID NO: 32400 - protein, 198 aa, Homo sapiens
  Payload ID: 6334
  Gene Symbol: FLYWCH1
  Gene Name: FLYWCH-type zinc finger 1
  ENSP ID: ENSP00000461566
  MOD_RES (1)..(1): Any amino acid
XGEKVYWTCRDQARMGCRSRAITQGRRVTVMRGHCHPPDLGGLEALRQREKRPNTAQRGSPERQCCEVPASSSPPLLTPQSPGVTPLPARLSGATPLSPIRLLSSFVPRGPRVIPLTNQARRTLHASLGGCWGRTSDAADTASLKAWQGGPEFLKTPLGGSFLVYESFLYRREKAAGEKVYWTCRDQARMGCRSRAIT

SEQ ID NO: 32401 - protein, 662 aa, Homo sapiens
  Payload ID: 6335
  Gene Symbol:
  Gene Name: FMN1
  ENSP ID: ENSP00000487643
MEGTHCTLQLHKPITELCYISFCLPKGEVRGFSYKGTVTLDRSNKGFHNCYQVREESDIISLSQEPDEHPGDIFFKQTPTKDILTELYKLTTERERLLTNLLSSDHILGITMGNQEGKLQELSVSLAPEDDCFQSAGDWQGELPVGPLNKRSTHGNKKPRRSSGRRESFGALPQKRTKRKGRGGRESAPLMGKDKICSSHSLPLSRTRPNLWVLEEKGNLLPNGALACSLQRRESCPPDIPKTPDTDLGFGSFETAFKDTGLGREVLPPDCSSTEAGGDGIRRPPSGLEHQQTGLSESHQDPEKHPEAEKDEMEKPAKRTCKQKPVSKVVAKVQDLSSQVQRVVKTHSKGKETIAIRPAAHAEFVPKADLLTLPGAEAGAHGSRRQGKERQGDRSSQSPAGETASISSVSASAEGAVNKVPLKVIESEKLDEAPEGKRLGFPVHTSVPHTRPETRNKRRAGLPLGGHKSLFLDLPHKVGPDSSQPRGDKKKPSPPAPAALGKVFNNSASQSSTHKQTSPVPSPLSPRLPSPQQHHRILRLPALPGEREAALNDSPCRKSRVFSGCVSADTLEPPSSAKVTETKGASPAFLRAGQPRLVPGETLEKSLGPGKTTAEPQHQSPPAFHWDLQQHFQEPVIRTVSISCASNLIKEEAGKGKESRSG

SEQ ID NO: 32402 - protein, 1321 aa, Homo sapiens
  Payload ID: 6335
  Gene Symbol:
  Gene Name: FMN1
  ENSP ID: ENSP00000487766
MEGTHCTLQLHKPITELCYISFCLPKGEVRGFSYKGTVTLDRSNKGFHNCYQVREESDIISLSQEPDEHPGDIFFKQTPTKDILTELYKLTTERERLLTNLLSSDHILGITMGNQEGKLQELSVSLAPEDDCFQSAGDWQGELPVGPLNKRSTHGNKKPRRSSGRRESFGALPQKRTKRKGRGGRESAPLMGKDKICSSHSLPLSRTRPNLWVLEEKGNLLPNGALACSLQRRESCPPDIPKTPDTDLGFGSFETAFKDTGLGREVLPPDCSSTEAGGDGIRRPPSGLEHQQTGLSESHQDPEKHPEAEKDEMEKPAKRTCKQKPVSKVVAKVQDLSSQVQRVVKTHSKGKETIAIRPAAHAEFVPKADLLTLPGAEAGAHGSRRQGKERQGDRSSQSPAGETASISSVSASAEGAVNKVPLKVIESEKLDEAPEGKRLGFPVHTSVPHTRPETRNKRRAGLPLGGHKSLFLDLPHKVGPDSSQPRGDKKKPSPPAPAALGKVFNNSASQSSTHKQTSPVPSPLSPRLPSPQQHHRILRLPALPGEREAALNDSPCRKSRVFSGCVSADTLEPPSSAKVTETKGASPAFLRAGQPRLVPGETLEKSLGPGKTTAEPQHQSPPEYQAAILHLKREHKEEIENLQAQFELRAFHIRGEHAMITARLEETIENLKHELEHRWRGGCEERKDVCISTDDDCPPKTFRNVCVQTDRETFLKPCESESKTTRSNQLVPKKLNISSLSQLSPPNDHKDIHAALQPMEGMASNQQKALPPPPASIPPPPPLPSGLGSLSPAPPMPPVSAGPPLPPPPPPPPPLPPPSSAGPPPPPPPPPLPNSPAPPNPGGPPPAPPPPGLAPPPPPGLFFGLGSSSSQCPRKPAIEPSCPMKPLYWTRIQISDRSQNATPTLWDSLEEPDIRDPSEFEYLFSKDTTQQKKKPLSETYEKKNKVKKIIKLLDGKRSQTVGILISSLHLEMKDIQQAIFNVDDSVVDLETLAALYENRAQEDELVKIRKYYETSKEEELKLLDKPEQFLHELAQIPNFAERAQCIIFRSVFSEGITSLHRKVEIITRASKDLLHVKSVKDILALILAFGNYMNGGNRTRGQADGYSLEILPKLKDVKSRDNGINLVDYVVKYYLRYYDQEAGTEKSVFPLPEPQDFFLASQVKFEDLIKDLRKLKRQLEASEKQMVVVCKESPKEYLQPFKDKLEEFFQKAKKEHKMEESHLENAQKSFETTVRYFGMKPKSGEKEITPSYVFMVWYEFCSDFKTIWKRESKNISKERLKMAQESVSKLTSEKKVETKKINPTASLKERLRQKEASVTTN

SEQ ID NO: 32403 - protein, 1196 aa, Homo sapiens
  Payload ID: 6335
  Gene Symbol:
  Gene Name: FMN1
  ENSP ID: ENSP00000488198
MENVDNSLDGSDVSEPAKPEAGLEVAQSILSKFSMKSLFGFTSKLESVNPEEEDAVLKAFHSLDVNPTSQQDDSSNGLDPQEAGSRVSPDLGNDEKIASVETESEGSQRKEAGTSLLAQELLPLSTLKGTKDDVICVRGTLVHTTSDSDSDDGGQEPEEGSSTNGPKSPSGVLSEPSQESKENPGGFRENTVTGEMNGAELCAEDPQRIPPEMSSKLEAGNGGLQTERRPSQDQVGEEGSQDLPAVTNQNSSVGITESASSKKEVSGEKSFQLPAFFSGLRVLKKGATAEGGETITEIKPKDGDLALLKLTQPVQKSLVQAGLQTVKSEKKATDPKATPTLLEQLSLLLNIDMPKTEPKGADPESPRREEMGCNADQESQSGPGVPQTQGGEVKPKSPETALEAFKALFIRPPRKGTTADTSELEALKRKMRHEKESLRAVFERSNSKPADGPSDSKSPDHSLTEQDDRTPGRLQAVWPPPKTKDTEEKVGLKYTEAEYQAAILHLKREHKEEIENLQAQFELRAFHIRGEHAMITARLEETIENLKHELEHRWRGGCEERKDVCISTDDDCPPKTFRNVCVQTDRETFLKPCESESKTTRSNQLVPKKLNISSLSQLSPPNDHKDIHAALQPMEGMASNQQKALPPPPASIPPPPPLPSGLGSLSPAPPMPPVSAGPPLPPPPPPPPPLPPPSSAGPPPPPPPPPLPNSPAPPNPGGPPPAPPPPGLAPPPPPGLFFGLGSSSSQCPRKPAIEPSCPMKPLYWTRIQISDRSQNATPTLWDSLEEPDIRDPSEFEYLFSKDTTQQKKKPLSETYEKKNKVKKIIKLLDGKRSQTVGILISSLHLEMKDIQQAIFNVDDSVVDLETLAALYENRAQEDELVKIRKYYETSKEEELKLLDKPEQFLHELAQIPNFAERAQCIIFRSVFSEGITSLHRKVEIITRASKDLLHVKSVKDILALILAFGNYMNGGNRTRGQADGYSLEILPKLKDVKSRDNGINLVDYVVKYYLRYYDQEAGTEKSVFPLPEPQDFFLASQVKFEDLIKDLRKLKRQLEASEKQMVVVCKESPKEYLQPFKDKLEEFFQKAKKEHKMEESHLENAQKSFETTVRYFGMKPKSGEKEITPSYVFMVWYEFCSDFKTIWKRESKNISKERLKMAQESVSKLTSEKKVETKKINPTASLKERLRQKEASVTTN

SEQ ID NO: 32404 - protein, 1419 aa, Homo sapiens
  Payload ID: 6335
  Gene Symbol:
  Gene Name: FMN1
  ENSP ID: ENSP00000488300
MEGTHCTLQLHKPITELCYISFCLPKGEVRGFSYKGTVTLDRSNKGFHNCYQVREESDIISLSQEPDEHPGDIFFKQTPTKDILTELYKLTTERERLLTNLLSSDHILGITMGNQEGKLQELSVSLAPEDDCFQSAGDWQGELPVGPLNKRSTHGNKKPRRSSGRRESFGALPQKRTKRKGRGGRESAPLMGKDKICSSHSLPLSRTRPNLWVLEEKGNLLPNGALACSLQRRESCPPDIPKTPDTDLGFGSFETAFKDTGLGREVLPPDCSSTEAGGDGIRRPPSGLEHQQTGLSESHQDPEKHPEAEKDEMEKPAKRTCKQKPVSKVVAKVQDLSSQVQRVVKTHSKGKETIAIRPAAHAEFVPKADLLTLPGAEAGAHGSRRQGKERQGDRSSQSPAGETASISSVSASAEGAVNKVPLKVIESEKLDEAPEGKRLGFPVHTSVPHTRPETRNKRRAGLPLGGHKSLFLDLPHKVGPDSSQPRGDKKKPSPPAPAALGKVFNNSASQSSTHKQTSPVPSPLSPRLPSPQQHHRILRLPALPGEREAALNDSPCRKSRVFSGCVSADTLEPPSSAKVTETKGASPAFLRAGQPRLVPGETLEKSLGPGKTTAEPQHQSPPGISSEGFPWDGFNEQTPKDLPNRDGGAWVLGYRAGPACPFLLHEEREKSNRSELYLDLHPDHSLTEQDDRTPGRLQAVWPPPKTKDTEEKVGLKYTEAEYQAAILHLKREHKEEIENLQAQFELRAFHIRGEHAMITARLEETIENLKHELEHRWRGGCEERKDVCISTDDDCPPKTFRNVCVQTDRETFLKPCESESKTTRSNQLVPKKLNISSLSQLSPPNDHKDIHAALQPMEGMASNQQKALPPPPASIPPPPPLPSGLGSLSPAPPMPPVSAGPPLPPPPPPPPPLPPPSSAGPPPPPPPPPLPNSPAPPNPGGPPPAPPPPGLAPPPPPGLFFGLGSSSSQCPRKPAIEPSCPMKPLYWTRIQISDRSQNATPTLWDSLEEPDIRDPSEFEYLFSKDTTQQKKKPLSETYEKKNKVKKIIKLLDGKRSQTVGILISSLHLEMKDIQQAIFNVDDSVVDLETLAALYENRAQEDELVKIRKYYETSKEEELKLLDKPEQFLHELAQIPNFAERAQCIIFRSVFSEGITSLHRKVEIITRASKDLLHVKSVKDILALILAFGNYMNGGNRTRGQADGYSLEILPKLKDVKSRDNGINLVDYVVKYYLRYYDQEAGTEKSVFPLPEPQDFFLASQVKFEDLIKDLRKLKRQLEASEKQMVVVCKESPKEYLQPFKDKLEEFFQKAKKEHKMEESHLENAQKSFETTVRYFGMKPKSGEKEITPSYVFMVWYEFCSDFKTIWKRESKNISKERLKMAQESVSKLTSEKKVETKKINPTASLKERLRQKEASVTTN

SEQ ID NO: 32405 - protein, 58 aa, Homo sapiens
  Payload ID: 6335
  Gene Symbol:
  Gene Name: FMN1
  ENSP ID: ENSP00000488453
  MOD_RES (1)..(1): Any amino acid
XFLHELAQIPNFAERAQCIIFRSVFSEGITSLHRKVEIITRASKQLLILLVPSLPTAY

SEQ ID NO: 32406 - protein, 1419 aa, Homo sapiens; identical to SEQ ID NO: 32404
  Payload ID: 6335
  Gene Symbol:
  Gene Name: FMN1
  ENSP ID: ENSP00000488532

SEQ ID NO: 32407 - protein, 181 aa, Homo sapiens
  Payload ID: 6335
  Gene Symbol:
  Gene Name: FMN1
  ENSP ID: ENSP00000488562
  MOD_RES (1)..(1): Any amino acid
XIKLLDGKRSQTVGILISSLHLEMKDIQQAIFNVDDSVVDLETLAALYENRAQEDELVKIRKYYETSKEEELKLLDKPEQFLHELAQIPNFAERAQCIIFRSVFSEGITSLHRKVEIITRASKDLLHVKSVKDILALILAFGNYMNGGNRTRGQADGYSLEILPKLKDVKSRVFIFHNKFP

SEQ ID NO: 32408 - protein, 114 aa, Homo sapiens
  Payload ID: 6335
  Gene Symbol:
  Gene Name: FMN1
  ENSP ID: ENSP00000488762
  MOD_RES (1)..(1): Any amino acid
XPQDFFLASQVKFEDLIKDLRKLKRQLEASEKQMVVVCKESPKEYLQPFKDKLEEFFQKGHPFPMSACCASVGVKHLFLLESAQRGFSKKWKTIATLTSDGSHVKQSAVPLFPR

SEQ ID NO: 32409 - protein, 503 aa, Homo sapiens
  Payload ID: 6335
  Gene Symbol:
  Gene Name: FMN1
  ENSP ID: ENSP00000488866
MENVDNSLDGSDVSEPAKPEAGLEVAQSILSKFSMKSLFGFTSKLESVNPEEEDAVLKAFHSLDVNPTSQQDDSSNGLDPQEAGSRVSPDLGNDEKIASVETESEGSQRKEAGTSLLAQELLPLSTLKGTKDDVICVRGTLVHTTSDSDSDDGGQEPEEGSSTNGPKSPSGVLSEPSQESKENPGGFRENTVTGEMNGAELCAEDPQRIPPEMSSKLEAGNGGLQTERRPSQDQVGEEGSQDLPAVTNQNSSVGITESASSKKEVSGEKSFQLPAFFSGLRVLKKGATAEGGETITEIKPKDGDLALLKLTQPVQKSLVQAGLQTVKSEKKATDPKATPTLLEQLSLLLNIDMPKTEPKGADPESPRREEMGCNADQESQSGPGVPQTQGGEVKPKSPETALEAFKALFIRPPRKGTTADTSELEALKRKMRHEKESLRAVFERSNSKPADGPSDSKSPDHSLTEQDDRTPGRLQAVWPPPKTKDTEEKVGLKYTEAGNVKGS

SEQ ID NO: 32410 - protein, 1338 aa, Homo sapiens
  Payload ID: 6336
  Gene Symbol: FLT1
  Gene Name: fms-related tyrosine kinase 1
  Uniprot ID: P17948
  ENSP ID: ENSP00000282397
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 32411 - protein, 733 aa, Homo sapiens
  Payload ID: 6336
  Gene Symbol: FLT1
  Gene Name: fms-related tyrosine kinase 1
  Uniprot ID: P17948
  ENSP ID: ENSP00000437631
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPELYTSTSPSSSSSSPLSSSSSSSSSSSS

SEQ ID NO: 32412 - protein, 361 aa, Homo sapiens
  Payload ID: 6336
  Gene Symbol: FLT1
  Gene Name: fms-related tyrosine kinase 1
  Uniprot ID: P17948
  ENSP ID: ENSP00000437841
MNSDLLVDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 32413 - protein, 541 aa, Homo sapiens
  Payload ID: 6336
  Gene Symbol: FLT1
  Gene Name: fms-related tyrosine kinase 1
  Uniprot ID: P17948
  ENSP ID: ENSP00000442630
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKLPPANSSFMLPPTSFSSNYFHFLP

SEQ ID NO: 32414 - protein, 85 aa, Homo sapiens
  Payload ID: 6336
  Gene Symbol: FLT1
  Gene Name: fms-related tyrosine kinase 1
  ENSP ID: ENSP00000443311
MLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 32415 - protein, 687 aa, Homo sapiens
  Payload ID: 6336
  Gene Symbol: FLT1
  Gene Name: fms-related tyrosine kinase 1
  Uniprot ID: P17948
  ENSP ID: ENSP00000484039
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRGEHCNKKAVFSRISKFKSTRNDCTTQSNVKH

SEQ ID NO: 32416 - protein, 433 aa, Homo sapiens
  Payload ID: 6336
  Gene Symbol: FLT1
  Gene Name: fms-related tyrosine kinase 1
  ENSP ID: ENSP00000484385
MVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 32417 - protein, 85 aa, Homo sapiens; identical to SEQ ID NO: 32414
  Payload ID: 6336
  Gene Symbol: FLT1
  Gene Name: fms-related tyrosine kinase 1
  ENSP ID: ENSP00000484832

SEQ ID NO: 32418 - protein, 993 aa, Homo sapiens
  Payload ID: 6337
  Gene Symbol: FLT3
  Gene Name: fms-related tyrosine kinase 3
  Uniprot ID: P36888
  ENSP ID: ENSP00000241453
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 32419 - protein, 739 aa, Homo sapiens
  Payload ID: 6337
  Gene Symbol: FLT3
  Gene Name: fms-related tyrosine kinase 3
  ENSP ID: ENSP00000370374
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSKKK

SEQ ID NO: 32420 - protein, 153 aa, Homo sapiens
  Payload ID: 6338
  Gene Symbol: FLT3LG
  Gene Name: fms-related tyrosine kinase 3 ligand
  Uniprot ID: P49771
  ENSP ID: ENSP00000204637
MERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 32421 - protein, 235 aa, Homo sapiens
  Payload ID: 6338
  Gene Symbol: FLT3LG
  Gene Name: fms-related tyrosine kinase 3 ligand
  Uniprot ID: P49771
  ENSP ID: ENSP00000468977
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 32422 - protein, 187 aa, Homo sapiens
  Payload ID: 6338
  Gene Symbol: FLT3LG
  Gene Name: fms-related tyrosine kinase 3 ligand
  ENSP ID: ENSP00000469181
  MOD_RES (1)..(1): Any amino acid
XAVKIRELSDYLLQDYPVTVASNLQDEELCGGLWRLVLAQRWMERLKTVAGSKMQGLLERVNTEIHFVTKCAFQETSEQLVALKPWITRQNFSRCLELQCQPGAPRPQSPGPAACGALTWPRPHPGEDTEAHRGESPARGCIAWTQRKLARGRSLPWAPLIPSPEWRQRQNPAPAPFTQLCTKPLSP

SEQ ID NO: 32423 - protein, 235 aa, Homo sapiens; identical to SEQ ID NO: 32421
  Payload ID: 6338
  Gene Symbol: FLT3LG
  Gene Name: fms-related tyrosine kinase 3 ligand
  Uniprot ID: P49771
  ENSP ID: ENSP00000469613

SEQ ID NO: 32424 - protein, 217 aa, Homo sapiens
  Payload ID: 6338
  Gene Symbol: FLT3LG
  Gene Name: fms-related tyrosine kinase 3 ligand
  ENSP ID: ENSP00000469942
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 32425 - protein, 235 aa, Homo sapiens; identical to SEQ ID NO: 32421
  Payload ID: 6338
  Gene Symbol: FLT3LG
  Gene Name: fms-related tyrosine kinase 3 ligand
  Uniprot ID: P49771
  ENSP ID: ENSP00000470453

SEQ ID NO: 32426 - protein, 153 aa, Homo sapiens; identical to SEQ ID NO: 32420
  Payload ID: 6338
  Gene Symbol: FLT3LG
  Gene Name: fms-related tyrosine kinase 3 ligand
  Uniprot ID: P49771
  ENSP ID: ENSP00000471226

SEQ ID NO: 32427 - protein, 58 aa, Homo sapiens
  Payload ID: 6338
  Gene Symbol: FLT3LG
  Gene Name: fms-related tyrosine kinase 3 ligand
  ENSP ID: ENSP00000471860
MTVLAPAWSPTTYLLLLLLLSSGLSGTQDCSFQHSPISSDFAVKIRELPGLILFSPAV

SEQ ID NO: 32428 - protein, 58 aa, Homo sapiens; identical to SEQ ID NO: 32427
  Payload ID: 6338
  Gene Symbol: FLT3LG
  Gene Name: fms-related tyrosine kinase 3 ligand
  ENSP ID: ENSP00000472628

SEQ ID NO: 32429 - protein, 132 aa, Homo sapiens
  Payload ID: 6338
  Gene Symbol: FLT3LG
  Gene Name: fms-related tyrosine kinase 3 ligand
  ENSP ID: ENSP00000473098
  MOD_RES (1)..(1): Any amino acid
XSCLRFVQTNISRLLQETSEQLVALKPWITRQNFSRCLELQCQPGAPRPQSPGPAACGALTWPRPHPGESFLGYGAWTLCLQVGRVTRRPWKGGEQWRGRGSSRCRKTPLGPGAVAHACNPSTLGGRGGWIT

SEQ ID NO: 32430 - protein, 1363 aa, Homo sapiens
  Payload ID: 6339
  Gene Symbol: FLT4
  Gene Name: fms-related tyrosine kinase 4
  Uniprot ID: P35916
  ENSP ID: ENSP00000261937
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFSCKGPGQNVAVTRAHPDSQGRRRRPERGARGGQVFYNSEYGELSEPSEEDHCSPSARVTFFTDNSY

SEQ ID NO: 32431 - protein, 1298 aa, Homo sapiens
  Payload ID: 6339
  Gene Symbol: FLT4
  Gene Name: fms-related tyrosine kinase 4
  Uniprot ID: P35916
  ENSP ID: ENSP00000377016
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFR

SEQ ID NO: 32432 - protein, 142 aa, Homo sapiens
  Payload ID: 6339
  Gene Symbol: FLT4
  Gene Name: fms-related tyrosine kinase 4
  ENSP ID: ENSP00000421535
MVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLL

SEQ ID NO: 32433 - protein, 1306 aa, Homo sapiens
  Payload ID: 6339
  Gene Symbol: FLT4
  Gene Name: fms-related tyrosine kinase 4
  ENSP ID: ENSP00000426057
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFRGTRRTRGA

SEQ ID NO: 32434 - protein, 295 aa, Homo sapiens
  Payload ID: 6339
  Gene Symbol: FLT4
  Gene Name: fms-related tyrosine kinase 4
  ENSP ID: ENSP00000481134
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQKIPSSASSGSKDPSWRPRQETSW

SEQ ID NO: 32435 - protein, 359 aa, Homo sapiens
  Payload ID: 6340
  Gene Symbol:
  Gene Name: FO538757.2
  ENSP ID: ENSP00000485222
MTPVRMQHSLAGQTYAVPLIQPDLRREEAVQQMADALQYLQKVSGDIFSRWQVEQSRSQVQAIGEKVSLAQAKIEKIKGSKKAIKVFSSAKYPAPGRLQEYGSIFTGAQDPGLQRRPHRIQSKHRPLDERALQEKLKDFPVCVSTKPEPEDDAEEGLGGLPSNISSVSSLLLFNTTENLQGKKYVFLDPLAGAVTKTHVMLGAETEEKLFDAPLSISKREQLEQQVPENYFYVPDLGQVPEIDVPSYLPDLSGIANDLMYIADLGPGIAPSAPGTIPELPTFHTEVAEPLKVVRATSQGGHLMSDLFNKLVMRRKGISGKGPGAGEGPGGAFARVSDSIPPLPPPQQPQAEEDEDDWES

SEQ ID NO: 32436 - protein, 455 aa, Homo sapiens
  Payload ID: 6340
  Gene Symbol:
  Gene Name: FO538757.2
  ENSP ID: ENSP00000485351
MGAVCTSGARSERTMTPVRMQHSLAGQTYAVPLIQPDLRREEAVQQMADALQYLQKVSGDIFSRWVEQSRSQVQAIGEKVSLAQAKIEKIKGSKKAIKVFSSAKYPAPGRLQEYGSIFTGAQDPGLQRRPHRIQSKHRPLDERALQEKLKDFPVCVSTKPEPEDDAEEGLGGLPSNISSVSSLLLFNTTENLGKKYVFLDPLAGAVTKTHVMLGAETEEKLFDAPLSISKREQLEQQVPENYFYVPDLGQVPEIDVPSYLPDLSGIANDLMYIADLGPGIAPSAPGTIPELPTFHTEVAEPLKTYKMGYTPPPPPPPPPPAPEVLASAPPLPPSTAAPVGQGARQDDSSSSASPSVQGAPREVVDPSGGRATLLESIRQAGGIGKAKLRSMKERKLEKKKQKEQEQVRATSQGGHLIWGGDFCLPVLHGGTAPPSLRHCVLKRLPEKTAHQSIKN

SEQ ID NO: 32437 - protein, 464 aa, Homo sapiens
  Payload ID: 6340
  Gene Symbol:
  Gene Name: FO538757.2
  ENSP ID: ENSP00000485442
MTPVRMQHSLAGQTYAVPLIQPDLRREEAVQQMADALQYLQKVSGDIFSRISQQVEQSRSQVQAIGEKVSLAQAKIEKIKGSKKAIKVFSSAKYPAPGRLQEYGSIFTGAQDPGLQRRPHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLSGIANDLMYIADLGPGIAPSAPGTIPELPTFHTEVAEPLKVDLQDGVLTPPPPPPPPPPAPEVLASAPPLPPSTAAPVGQGARQDDSSSSASPSVQGAPREVVDPSGGRATLLESIRQAGGIGKAKLRSMKERKLEKKKQKEQEQVRATSQGGHLMSDLFNKLVMRRKGISGKGPGAGEGPGGAFARVSDSIPPLPPPQQPQAEEDEDDWES

SEQ ID NO: 32438 - protein, 133 aa, Homo sapiens
  Payload ID: 6341
  Gene Symbol:
  Gene Name: FO538757.3
  ENSP ID: ENSP00000485457
MSDSINFSHNLGQLLSPPRCVVMPGMPFPSIRSPELQKTTADLDHTLVSVPSVAESLHHPEITFLTAFCLPSFTRSRPLPDRQLHHCLALCPSFALPAGDGVCHGPGLQGSCYKGETQESVESRVLPGPRHRH

SEQ ID NO: 32439 - protein, 1801 aa, Homo sapiens
  Payload ID: 6342
  Gene Symbol: FOCAD
  Gene Name: focadhesin
  Uniprot ID: Q5VW36
  ENSP ID: ENSP00000344307
MSDDIRKRFEFPNSLIQSQAVGHLIAAVLKENGFSEKIHQSTNQTPALNLLWEKCCSDNVVVRTACCEGLVALVAQDHAEFSYVLNGILNLIPSTRNTHGLIKAIMHLLQMQALKEGQGGEKNIQSIYTIRNHPHPLITVLEHRPDCWPVFLQQLTAFFQQCPERLEVSCIQIMAPFLWYLYCEPSQLQEYAKLRLALLKVLLQPQVLCDKDQPSILEQQILQLCCDIVPCLQVKDLIQTTEAMMFIEEVCLSLLRHPVFWKIQLTQMSLQLLCVSEVSLKITGECSSSIHLLEHSVELLKEDFPVELVIIGIALLLLQTPASQQKPILNLALKLLSVTEDQKIPKSSLLLVMPILQILSSTALEDCISVDEEGPSRQQLALNLLEMIQQECYRDDHQKLSYKLVCPVTSMYGTIFTAWRILEVMTDSSAASDWLASVESLLPITAVIPAPAFLLLAHLLVEDKGQNLHQILKVTTELAQADSSQVPNLIPVLMFKLGRPLEPILYNDILYTLPKLGVHKVCIGQILRIIQLLGTTPRLRAVTLRLLTSLWEKQDRVYPELQRFMAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYENFKVQVLSFLWTHTQNKDPIVANAAYRSLANFSAGEHTILHLPEKIRPEIPIPEELDDDEDVEDVDLSVPGSCYLKLLSLTPPLVLPALEEFFTSLVKQEMVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQLKHGKEEPEEVQYKKSTAWLWVRDMLTDEITKAAAKESPVVKGNALLALSSLAVVVSRHEASLSSDSDGLLEVQPNFLSMKEWVSMVLDTLLVIVDSHYQPRGQLLSWFYYKSYSGENTASAIARSAAATALSLLVPVFIISCKEKVEEILNMLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTEGTPTMLCLAALHGMVALVGSEGDVMQLKSEAIQTSHFQGRLNEVIRTLTQVISVSGVIGLQSNAVWLLGHLHLSTLSSSQSRASVPTDYSYLPESSFIGAAIGFFITGGKKGPESVPPSLLKVVMKPIATVGESYQYPPVNWAALLSPLMRLNFGEEIQQLCLEIMVTQAQSSQNAAALLGLWVTPPLIHSLSLNTKRYLLISAPLWIKHISDEQILGFVENLMVAVFKAASPLGSPELCPSALHGLSQAMKLPSPAHHLWSLLSEATGKIFDLLPNKIRRKDLELYISIAKCLLEMTDDDANRIAQVTKSNIEKAAFVKLYLVSQGRFPLVNLTDMLSVAVQHREKEVLAWMILHSLYQARIVSHANTGVLKRMEWLLELMGYIRNVAYQSTSFHNTALDKALDFFLLIFATAVVAWADHTAPLLLGLSASWLPWHQENGPAGPVPSFLGRSPMHRVTLQEVLTLLPNSMALLLQKEPWKEQTQKFIDWLFSIMESPKEALSAQSRDLLKATLLSLRVLPEFKKKAVWTRAYGW

SEQ ID NO: 32440 - protein, 1801 aa, Homo sapiens; identical to SEQ ID NO: 32439
  Payload ID: 6342
  Gene Symbol: FOCAD
  Gene Name: focadhesin
  Uniprot ID: Q5VW36
  ENSP ID: ENSP00000369599

SEQ ID NO: 32441 - protein, 180 aa, Homo sapiens
  Payload ID: 6342
  Gene Symbol: FOCAD
  Gene Name: focadhesin
  ENSP ID: ENSP00000474563
MPKVFSVYFVCLCPALGKICDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTE

SEQ ID NO: 32442 - protein, 99 aa, Homo sapiens
  Payload ID: 6342
  Gene Symbol: FOCAD
  Gene Name: focadhesin
  ENSP ID: ENSP00000474683
MLTARLPGKPSADESQAVQIHMGLALGMFLSRLCEEKLSDISGQEMNLLLMKSLDALENCCFDTSLEYNTGCILGVGLVLSLMSHSSQMQSRVHVAALL

SEQ ID NO: 32443 - protein, 1237 aa, Homo sapiens
  Payload ID: 6342
  Gene Symbol: FOCAD
  Gene Name: focadhesin
  ENSP ID: ENSP00000474915
MAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYENFKVQVLSFLWTHTQNKDPIVANAAYRSLANFSAGEHTILHLPEKIRPEIPIPEELDDDEDVEDVDLSVPGSCYLKLLSLTPPLVLPALEEFFTSLVKQEMVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQLKHGKEEPEEVQYKKSTAWLWVRDMLTDEITKAAAKESPVVKGNALLALSSLAVVVSRHEASLSSDSDGLLEVQPNFLSMKEWVSMVLDTLLVIVDSHYQPRGQLLSWFYYKSYSGENTASAIARSAAATALSLLVPVFIISCKEKVEEILNMLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTEGTPTMLCLAALHGMVALVGSEGDVMQLKSEAIQTSHFQGRLNEVIRTLTQVISVSGVIGLQSNAVWLLGHLHLSTLSSSQSRASVPTDYSYLPESSFIGAAIGFFITGGKKGPESVPPSLLKVVMKPIATVGESYQYPPVNWAALLSPLMRLNFGEEIQQLCLEIMVTQAQSSQNAAALLGLWVTPPLIHSLSLNTKRYLLISAPLWIKHISDEQILGFVENLMVAVFKAASPLGSPELCPSALHGLSQAMKLPSPAHHLWSLLSEATGKIFDLLPNKIRRKDLELYISIAKCLLEMTDDDANRIAQVTKSNIEKAAFVKLYLVSQGRFPLVNLTDMLSVAVQHREKEVLAWMILHSLYQARIVSHANTGVLKRMEWLLELMGYIRNVAYQSTSFHNTALDKALDFFLLIFATAVVAWADHTAPLLLGLSASWLPWHQENGPAGPVPSFLGRSPMHRVTLQEVLTLLPNSMALLLQKEPWKEQTQKFIDWLFSIMESPKEALSAQSRDLLKATLLSLRVLPEFKKKAVWTRAYGW

SEQ ID NO: 32444 - protein, 46 aa, Homo sapiens
  Payload ID: 6342
  Gene Symbol: FOCAD
  Gene Name: focadhesin
  ENSP ID: ENSP00000475030
MAVSDVPSLSVGKEVQWEKLIAKAASIRDICHINMVQICWQLFLKC

SEQ ID NO: 32445 - protein, 128 aa, Homo sapiens
  Payload ID: 6342
  Gene Symbol: FOCAD
  Gene Name: focadhesin
  ENSP ID: ENSP00000475075
MLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVC

SEQ ID NO: 32446 - protein, 750 aa, Homo sapiens
  Payload ID: 6343
  Gene Symbol: FOLH1
  Gene Name: folate hydrolase (prostate-specific membrane antigen) 1
  Uniprot ID: Q04609
  ENSP ID: ENSP00000256999
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 32447 - protein, 442 aa, Homo sapiens
  Payload ID: 6343
  Gene Symbol: FOLH1
  Gene Name: folate hydrolase (prostate-specific membrane antigen) 1
  Uniprot ID: Q04609
  ENSP ID: ENSP00000344086
MGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 32448 - protein, 735 aa, Homo sapiens
  Payload ID: 6343
  Gene Symbol: FOLH1
  Gene Name: folate hydrolase (prostate-specific membrane antigen) 1
  Uniprot ID: Q04609
  ENSP ID: ENSP00000344131
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 32449 - protein, 719 aa, Homo sapiens
  Payload ID: 6343
  Gene Symbol: FOLH1
  Gene Name: folate hydrolase (prostate-specific membrane antigen) 1
  Uniprot ID: Q04609
  ENSP ID: ENSP00000349129
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 32450 - protein, 48 aa, Homo sapiens
  Payload ID: 6343
  Gene Symbol: FOLH1
  Gene Name: folate hydrolase (prostate-specific membrane antigen) 1
  ENSP ID: ENSP00000431263
MWNLLHETDSAVATARRPRWLCAGALVLAGGFFLLGFLFVTEASLGTV

SEQ ID NO: 32451 - protein, 704 aa, Homo sapiens
  Payload ID: 6343
  Gene Symbol: FOLH1
  Gene Name: folate hydrolase (prostate-specific membrane antigen) 1
  Uniprot ID: Q04609
  ENSP ID: ENSP00000431463
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 32452 - protein, 64 aa, Homo sapiens
  Payload ID: 6343
  Gene Symbol: FOLH1
  Gene Name: folate hydrolase (prostate-specific membrane antigen) 1
  ENSP ID: ENSP00000431577
MKAFLDELKAENIKKFLYNFTQIPHLAGTEQNFQLAKQIQSQWKEFGLDSVELAHYDVLLSYPN

SEQ ID NO: 32453 - protein, 74 aa, Homo sapiens
  Payload ID: 6343
  Gene Symbol: FOLH1
  Gene Name: folate hydrolase (prostate-specific membrane antigen) 1
  ENSP ID: ENSP00000434928
MWNLLHETDSAVATARRPRWLCAGALVLAGGFFLLGFLFGWFIKSSNEATNITPKHNMKAFLDELKAENIKKFL

SEQ ID NO: 32454 - protein, 46 aa, Homo sapiens
  Payload ID: 6343
  Gene Symbol: FOLH1
  Gene Name: folate hydrolase (prostate-specific membrane antigen) 1
  ENSP ID: ENSP00000436569
MWNLLHETDSAVATARRPRWLCAGALVLAGGFFLLGFLFVKVGKRN

SEQ ID NO: 32455 - protein, 257 aa, Homo sapiens
  Payload ID: 6344
  Gene Symbol: FOLR1
  Gene Name: folate receptor 1 (adult)
  Uniprot ID: P15328
  ENSP ID: ENSP00000308137
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 32456 - protein, 257 aa, Homo sapiens; identical to SEQ ID NO: 32455
  Payload ID: 6344
  Gene Symbol: FOLR1
  Gene Name: folate receptor 1 (adult)
  Uniprot ID: P15328
  ENSP ID: ENSP00000377281

SEQ ID NO: 32457 - protein, 257 aa, Homo sapiens; identical to SEQ ID NO: 32455
  Payload ID: 6344
  Gene Symbol: FOLR1
  Gene Name: folate receptor 1 (adult)
  Uniprot ID: P15328
  ENSP ID: ENSP00000377284

SEQ ID NO: 32458 - protein, 257 aa, Homo sapiens; identical to SEQ ID NO: 32455
  Payload ID: 6344
  Gene Symbol: FOLR1
  Gene Name: folate receptor 1 (adult)
  Uniprot ID: P15328
  ENSP ID: ENSP00000377286

SEQ ID NO: 32459 - protein, 255 aa, Homo sapiens
  Payload ID: 6345
  Gene Symbol: FOLR2
  Gene Name: folate receptor 2 (fetal)
  Uniprot ID: P14207
  ENSP ID: ENSP00000298223
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 32460 - protein, 210 aa, Homo sapiens
  Payload ID: 6345
  Gene Symbol: FOLR2
  Gene Name: folate receptor 2 (fetal)
  ENSP ID: ENSP00000321957
MLPAATEVQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYS

SEQ ID NO: 32461 - protein, 251 aa, Homo sapiens
  Payload ID: 6345
  Gene Symbol: FOLR2
  Gene Name: folate receptor 2 (fetal)
  ENSP ID: ENSP00000405638
MLPAATEVQLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSAALCEGLWSHSYKVSNYSRGSGRCIQMWFDSAQGNPNEEVARFYAAAMHVNAGEMLHGTGGLLLSLALMLQLWLLG

SEQ ID NO: 32462 - protein, 214 aa, Homo sapiens
  Payload ID: 6345
  Gene Symbol: FOLR2
  Gene Name: folate receptor 2 (fetal)
  ENSP ID: ENSP00000414094
MLPAATEVQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 32463 - protein, 198 aa, Homo sapiens
  Payload ID: 6345
  Gene Symbol: FOLR2
  Gene Name: folate receptor 2 (fetal)
  ENSP ID: ENSP00000438568
MLPAATELRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALC

SEQ ID NO: 32464 - protein, 169 aa, Homo sapiens
  Payload ID: 6345
  Gene Symbol: FOLR2
  Gene Name: folate receptor 2 (fetal)
  ENSP ID: ENSP00000440337
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSAALCEGLWSHS

SEQ ID NO: 32465 - protein, 180 aa, Homo sapiens
  Payload ID: 6345
  Gene Symbol: FOLR2
  Gene Name: folate receptor 2 (fetal)
  ENSP ID: ENSP00000441547
MLPAATEGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALC

SEQ ID NO: 32466 - protein, 148 aa, Homo sapiens
  Payload ID: 6345
  Gene Symbol: FOLR2
  Gene Name: folate receptor 2 (fetal)
  ENSP ID: ENSP00000443307
MLPAATEVQKDHAGSCGEGNLKGKKLEEGRLDTKHRAMLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYE

SEQ ID NO: 32467 - protein, 171 aa, Homo sapiens
  Payload ID: 6345
  Gene Symbol: FOLR2
  Gene Name: folate receptor 2 (fetal)
  ENSP ID: ENSP00000444794
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRT

SEQ ID NO: 32468 - protein, 244 aa, Homo sapiens
  Payload ID: 6345
  Gene Symbol: FOLR2
  Gene Name: folate receptor 2 (fetal)
  ENSP ID: ENSP00000480592
MLPAATEVQLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACSATSSRTPVSMSAHQPGALDPAGIRAGAKNASWMCPYAKRTVSAGGRIVTPPTRARATGTEDGTGPQELTSAQLGLSAAPLSPTSPLQLPFVKASGVTHTRSATTAEGAAAASRCGLIQPRATPTRKWRGSMLQPCM

SEQ ID NO: 32469 - protein, 104 aa, Homo sapiens
  Payload ID: 6346
  Gene Symbol: FOLR3
  Gene Name: folate receptor 3 (gamma)
  Uniprot ID: P41439
  ENSP ID: ENSP00000411161
MAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCL

SEQ ID NO: 32470 - protein, 74 aa, Homo sapiens
  Payload ID: 6346
  Gene Symbol: FOLR3
  Gene Name: folate receptor 3 (gamma)
  ENSP ID: ENSP00000446279
MAWQMMQLLLLALVTAAGSAQPRSARARTDLLNVCMNAKHHKTQPSPEDELYGQCSPWKKNACCTASTSQELHK

SEQ ID NO: 32471 - protein, 172 aa, Homo sapiens
  Payload ID: 6346
  Gene Symbol: FOLR3
  Gene Name: folate receptor 3 (gamma)
  ENSP ID: ENSP00000481027
MDMAWQMMQLLLLALVTAAGSAQPRSARARTDLLNVCMNAKHHKTQPSPEDELYGQVGAPQGPSPGSVPLDDLPGAEEPEYGGDGCGGERLSPVSSPPSAVPGRRMPAARPAPARSCTRTPPACTTLTGITVVRWNPPASATLSRTAVSMSAHPTWGPGSGRSTRAGAKSAF

SEQ ID NO: 32472 - protein, 245 aa, Homo sapiens
  Payload ID: 6346
  Gene Symbol: FOLR3
  Gene Name: folate receptor 3 (gamma)
  ENSP ID: ENSP00000481114
MDMAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCLYECSPNLGPWIRQVNQSWRKERILNVPLCKEDCERWWEDCRTSYTCKSNWHKGWNWTSGINECPAGALCSTFESYFPTPAALCEGLWSHSFKVSNYSRGSGRCIQMWFDSAQGNPNEEVAKFYAAAMNAGAPSRGIIDS

SEQ ID NO: 32473 - protein, 178 aa, Homo sapiens
  Payload ID: 6346
  Gene Symbol: FOLR3
  Gene Name: folate receptor 3 (gamma)
  ENSP ID: ENSP00000481833
MDMAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCLYECSPNLGPWIRQVNQSWRKERILNVPLCKEDCERWWEDCRTSYTCKSNWHKGWNWTSGINECPAGALCSTF

SEQ ID NO: 32474 - protein, 669 aa, Homo sapiens
  Payload ID: 6347
  Gene Symbol: FSHR
  Gene Name: follicle stimulating hormone receptor
  Uniprot ID: P23945
  ENSP ID: ENSP00000306780
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 32475 - protein, 695 aa, Homo sapiens
  Payload ID: 6347
  Gene Symbol: FSHR
  Gene Name: follicle stimulating hormone receptor
  ENSP ID: ENSP00000384708
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 32476 - protein, 152 aa, Homo sapiens
  Payload ID: 6347
  Gene Symbol: FSHR
  Gene Name: follicle stimulating hormone receptor
  ENSP ID: ENSP00000405775
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLSFSSFVLENAKVENGDHRAFSDRTNAL

SEQ ID NO: 32477 - protein, 278 aa, Homo sapiens
  Payload ID: 6347
  Gene Symbol: FSHR
  Gene Name: follicle stimulating hormone receptor
  ENSP ID: ENSP00000415504
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILSELHPICNKSILRQEVDYMTQARGQRSSLAEDNESSYSRGFDMTYTEFDYDLCNE

SEQ ID NO: 32478 - protein, 129 aa, Homo sapiens
  Payload ID: 6348
  Gene Symbol: FSHB
  Gene Name: follicle stimulating hormone, beta polypeptide
  Uniprot ID: P01225
  ENSP ID: ENSP00000254122
MKTLQFFFLFCCWKAICCNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKE

SEQ ID NO: 32479 - protein, 129 aa, Homo sapiens; identical to SEQ ID NO: 32478
  Payload ID: 6348
  Gene Symbol: FSHB
  Gene Name: follicle stimulating hormone, beta polypeptide
  Uniprot ID: P01225
  ENSP ID: ENSP00000416606

SEQ ID NO: 32480 - protein, 129 aa, Homo sapiens; identical to SEQ ID NO: 32478
  Payload ID: 6348
  Gene Symbol: FSHB
  Gene Name: follicle stimulating hormone, beta polypeptide
  Uniprot ID: P01225
  ENSP ID: ENSP00000433424

SEQ ID NO: 32481 - protein, 85 aa, Homo sapiens
  Payload ID: 6349
  Gene Symbol: FDCSP
  Gene Name: follicular dendritic cell secreted protein
  Uniprot ID: Q8NFU4
  ENSP ID: ENSP00000318437
MKKVLLLITAILAVAVGFPVSQDQEREKRSISDSDELASGFFVFPYPYPFRPLPPIPFPRFPWFRRNFPIPIPESAPTTPLPSEK

SEQ ID NO: 32482 - protein, 579 aa, Homo sapiens
  Payload ID: 6350
  Gene Symbol: FLCN
  Gene Name: folliculin
  Uniprot ID: Q8NFG4
  ENSP ID: ENSP00000285071
MNAIVALCHFCELHGPRTLFCTEVLHAPLPQGDGNEDSPGQGEQAEEEEGGIQMNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALKVFEAEQFGCPQRAQRMNTAFTPFLHQRNGNAARSLTSLTSDDNLWACLHTSFAWLLKACGSRLTEKLLEGAPTEDTLVQMEKLADLEEESESWDNSEAEEEEKAPVLPESTEGRELTQGPAESSSLSGCGSWQPRKLPVFKSLRHMRQVLGAPSFRMLAWHVLMGNQVIWKSRDVDLVQSAFEVLRTMLPVGCVRIIPYSSQYEEAYRCNFLGLSPHVQIPPHVLSSEFAVIVEVHAAARSTLHPVGCEDDQSLSKYEFVVTSGSPVAADRVGPTILNKIEAALTNQNLSVDVVDQCLVCLKEEWMNKVKVLFKFTKVDSRPKEDTQKLLSILGASEEDNVKLLKFWMTGLSKTYKSHLMSTVRSPTASESRN

SEQ ID NO: 32483 - protein, 342 aa, Homo sapiens
  Payload ID: 6350
  Gene Symbol: FLCN
  Gene Name: folliculin
  Uniprot ID: Q8NFG4
  ENSP ID: ENSP00000373821
MNAIVALCHFCELHGPRTLFCTEVLHAPLPQGDGNEDSPGQGEQAEEEEGGIQMNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALKVFEAEQFGCPQRAQRMNTAFTPFLHQRNGNAARSLTSLTSDDNLWACLHTSFAWLLKACGSRLTEKLLEGAPTEDTLVQMEKLAGEAGVLLPGPWPGWPWGGTSCLLSWQESLREGNAALNQPRTSLREAHPPISV

SEQ ID NO: 32484 - protein, 153 aa, Homo sapiens
  Payload ID: 6350
  Gene Symbol: FLCN
  Gene Name: folliculin
  ENSP ID: ENSP00000410410
MNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALK

SEQ ID NO: 32485 - protein, 37 aa, Homo sapiens
  Payload ID: 6350
  Gene Symbol: FLCN
  Gene Name: folliculin
  ENSP ID: ENSP00000463970
MNAIVALCHFCELHGPRTLFCTEVLHAPLPQGDGNED

SEQ ID NO: 32486 - protein, 1138 aa, Homo sapiens
  Payload ID: 6351
  Gene Symbol: FNIP1
  Gene Name: folliculin interacting protein 1
  Uniprot ID: Q8TF40
  ENSP ID: ENSP00000309266
MAPTLFQKLFSKRTGLGAPGRDARDPDCGFSWPLPEFDPSQIRLIVYQDCERRGRNVLFDSSVKRRNEDISVSKLGSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGDLYGAIGSPVRLARTVVVGKRQDMVQRLLYFLTYFIRCSELQETHLLENGEDEAIVMPGTVITTTLEKGEIEESEYVLVTMHRNKSSLLFKESEEIRTPNCNCKYCSHPLLGQNVENISQQEREDIQNSSKELLGISDECQMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLGIESSDLPLLAAVASTHSPYVAQILL

SEQ ID NO: 32487 - protein, 1121 aa, Homo sapiens
  Payload ID: 6351
  Gene Symbol: FNIP1
  Gene Name: folliculin interacting protein 1
  ENSP ID: ENSP00000310453
MAPTLFQKLFSKRTGLGAPGRDARDPDCGFSWPLPEFDPSQIRLIVYQDCERRGRNVLFDSSVKRRNEDISVSGSRCSSDANMLGEMMFGSVAMSYKGSTLKIHQIRSPPQLMLSKVFTARTGSSICGSLNTLQDSLEFINQDNNTLKADNNTVINGLLGNIGLSQFCSPRRAFSEQGPLRLIRSASFFAVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGDLYGAIGSPVRLARTVVVGKRQDMVQRLLYFLTYFIRCSELQETHLLENGEDEAIVMPGTVITTTLEKGEIEESEYVLVTMHRNKSSLLFKESEEIRTPNCNCKYCSHPLLGQNVENISQQEREDIQNSSKELLGISDECQMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLGIESSDLPLLAAVASTHSPYVAQILL

SEQ ID NO: 32488 - protein, 1166 aa, Homo sapiens
  Payload ID: 6351
  Gene Symbol: FNIP1
  Gene Name: folliculin interacting protein 1
  Uniprot ID: Q8TF40
  ENSP ID: ENSP00000421985
MAPTLFQKLFSKRTGLGAPGRDARDPDCGFSWPLPEFDPSQIRLIVYQDCERRGRNVLFDSSVKRRNEDISVSKLGSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIGLSQFCSPRRAFSEQGPLRLIRSASFFAVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGDLYGAIGSPVRLARTVVVGKRQDMVQRLLYFLTYFIRCSELQETHLLENGEDEAIVMPGTVITTTLEKGEIEESEYVLVTMHRNKSSLLFKESEEIRTPNCNCKYCSHPLLGQNVENISQQEREDIQNSSKELLGISDECQMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLGIESSDLPLLAAVASTHSPYVAQILL

SEQ ID NO: 32489 - protein, 508 aa, Homo sapiens
  Payload ID: 6351
  Gene Symbol: FNIP1
  Gene Name: folliculin interacting protein 1
  Uniprot ID: Q8TF40
  ENSP ID: ENSP00000425619
MAPTLFQKLFSKRTGLGAPGRDARDPDCGFSWPLPEFDPSQIRLIVYQDCERRGRNVLFDSSVKRRNEDISVSKLGSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIGLSQFCSPRRAFSEQGPLRLIRSASFFAVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGM

SEQ ID NO: 32490 - protein, 918 aa, Homo sapiens
  Payload ID: 6351
  Gene Symbol: FNIP1
  Gene Name: folliculin interacting protein 1
  ENSP ID: ENSP00000480650
MDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGDLYGAIGSPVRLARTVVVGKRQDMVQRLLYFLTYFIRCSELQETHLLENGEDEAIVMPGTVITTTLEKGEIEESEYVLVLLFKESEEIRTPNCNCKYCSHPLLGQNVENISQQEREDIQNSSKELLGISDECQMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLGIESSDLPLLAAVASTHSPYVAQILL

SEQ ID NO: 32491 - protein, 1114 aa, Homo sapiens
  Payload ID: 6352
  Gene Symbol: FNIP2
  Gene Name: folliculin interacting protein 2
  Uniprot ID: Q9P278
  ENSP ID: ENSP00000264433
MAPTLLQKLFNKRGSSGSSAAASAQGRAPKEGPAFSWSCSEFDLNEIRLIVYQDCDRRGRQVLFDSKAVQKIEEVTAQKTEDVPIKISAKCCQGSSSVSSSSSSSISSHSSSGGSSHHAKEQLPKYQYTRPASDVNMLGEMMFGSVAMSYKGSTLKIHYIRSPPQLMISKVFSARMGSFCGSTNNLQDSFEYINQDPNLGKLNTNQNSLGPCRTGSNLAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLMEALGEFRGTIWNLYSVPRIAEPVWLTMMSGTLEKNQLCQRFLKEFTLLIEQINKNQFFAALLTAVLTYHLAWVPTVMPVDHPPIKAFSEKRTSQSVNMLAKTHPYNPLWAQLGDLYGAIGSPVRLTRTVVVGKQKDLVQRILYVLTYFLRCSELQENQLTWSGNHGEGDQVLNGSKIITALEKGEVEESEYVVITVRNEPALVPPILPPTAAERHNPWPTGFPECPEGTDSRDLGLKPDKEANRRPEQGSEACSAGCLGPASDASWKPQNAFCGDEKNKEAPQDGSSRLPSCEVLGAGMKMDQQAVCELLKVEMPTRLPDRSVAWPCPDRHLREKPSLEKVTFQIGSFASPESDFESRMKKMEERVKACGPSLEASEAADVAQDPQVSRSPFKPGFQENVCCPQNRLSEGDEGESDKGFAEDRGSRNDMAADIAGQLSHAADLGTASHGAGGTGGRRLEATRGLYVKAAEGPVLEPVAPRCVQRGPGLVAGANIPCGDDNKKANFRTEGDIPRNESSDSALGDSDDEACASAMLDLGHGGDRTGGSLEVELPLPRSQSISTQNVRNFGRSLLAGYCPTYMPDLVLHGTGSDEKLKQCLVADLVHTVHHPVLDEPIAEAVCIIADTDKWSVQVATSQRKVTDNMKLGQDVLVSSQVSSLLQSILQLYKLHLPADFCIMHLEDRLQEMYLKSKMLSEYLRGHTRVHVKELGVVLGIESNDLPLLTAIASTHSPYVAQILL

SEQ ID NO: 32492 - protein, 241 aa, Homo sapiens
  Payload ID: 6352
  Gene Symbol: FNIP2
  Gene Name: folliculin interacting protein 2
  ENSP ID: ENSP00000420841
LMISKVFSARMGSFCGSTNNLQDSFEYINQDPNLGKLNTNQNSLGPCRTGSNLGLLQACSSKLLQGVAEGGPLRLTRSASFFAAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLM

SEQ ID NO: 32493 - protein, 673 aa, Homo sapiens
  Payload ID: 6352
  Gene Symbol: FNIP2
  Gene Name: folliculin interacting protein 2
  ENSP ID: ENSP00000421488
MCGGTANTTNQPESWQDSARCVSDAVPGAGRIYRALLCTKIKKHTGVDRSTDHTELDNSWSCSEFDLNEIRLIVYQDCDRRGRQVLFDSKAVQKIEEVTAQKTEDVPIKISAKCCQGSSSVSSSSSSSISSHSSSGGSSHHAKEQLPKYQYTRPASDVNMLGEMMFGSVAMSYKGSTLKIHYIRSPPQLMISKVFSARMGSFCGSTNNLQDSFEYINQDPNLGKLNTNQNSLGPCRTGSNLAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLMEALGEFRGTIWNLYSVPRIAEPVWLTMMSGTLEKNQLCQRFLKEFTLLIEQINKNQFFAALLTAVLTYHLAWVPTVMPVDHPPIKAFSEKRTSQSVNMLAKTHPYNPLWAQLGDLYGAIGSPVRLTRTVVVGKQKDLVQRILYVLTYFLRCSELQENQLTWSGNHGEGDQVLNGSKIITALEKGEVEESEYVVITVRNEPALVPPILPPTAAERHNPWPTGFPECPEGTDSRDLGLKPDKEANRRPEQGSEACSAGCLGPASDASWKPQNAFCG

SEQ ID NO: 32494 - protein, 219 aa, Homo sapiens
  Payload ID: 6353
  Gene Symbol: FIGLA
  Gene Name: folliculogenesis specific bHLH transcription factor
  Uniprot ID: Q6QHK4
  ENSP ID: ENSP00000333097
MDPAPGVLDPRAAPPALLGTPQAEVLEDVLREQFGPLPQLAAVCRLKRLPSGGYSSTENLQLVLERRRVANAKERERIKNLNRGFARLKALVPFLPQSRKPSKVDILKGATEYIQVLSDLLEGAKDSKKQDPDEQSYSNNSSESHTSSARQLSRNITQHISCAFGLKNEEEGPWADGGSGEPAHACRHSVMSTTEIISPTRSLDRFPEVELLSHRLPQV

SEQ ID NO: 32495 - protein, 344 aa, Homo sapiens
  Payload ID: 6354
  Gene Symbol: FST
  Gene Name: follistatin
  Uniprot ID: P19883
  ENSP ID: ENSP00000256759
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 32496 - protein, 317 aa, Homo sapiens
  Payload ID: 6354
  Gene Symbol: FST
  Gene Name: follistatin
  Uniprot ID: P19883
  ENSP ID: ENSP00000380151
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCN

SEQ ID NO: 32497 - protein, 215 aa, Homo sapiens
  Payload ID: 6354
  Gene Symbol: FST
  Gene Name: follistatin
  ENSP ID: ENSP00000426315
GPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCITKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 32498 - protein, 102 aa, Homo sapiens
  Payload ID: 6354
  Gene Symbol: FST
  Gene Name: follistatin
  ENSP ID: ENSP00000426971
  MOD_RES (1)..(1): Any amino acid
XSACHLRKATCLLGRSIGLAYEGKCITKSCEDIQCTGGKKCLWDFKVGRGRCSLCDELCPDSKSDEPVCASDNATYASECAMKEAACSSGVLLEVKHSGSCN

SEQ ID NO: 32499 - protein, 308 aa, Homo sapiens
  Payload ID: 6355
  Gene Symbol: FSTL1
  Gene Name: follistatin-like 1
  Uniprot ID: Q12841
  ENSP ID: ENSP00000295633
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 32500 - protein, 273 aa, Homo sapiens
  Payload ID: 6355
  Gene Symbol: FSTL1
  Gene Name: follistatin-like 1
  Uniprot ID: Q12841
  ENSP ID: ENSP00000394355
MWKRWLALALALVAVAWVRAEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 32501 - protein, 20 aa, Homo sapiens
  Payload ID: 6355
  Gene Symbol: FSTL1
  Gene Name: follistatin-like 1
  ENSP ID: ENSP00000418389
  MOD_RES (1)..(1): Any amino acid
XSFQEFLKCLNPSFNPPEKK

SEQ ID NO: 32502 - protein, 139 aa, Homo sapiens
  Payload ID: 6355
  Gene Symbol: FSTL1
  Gene Name: follistatin-like 1
  ENSP ID: ENSP00000418505
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWF

SEQ ID NO: 32503 - protein, 263 aa, Homo sapiens
  Payload ID: 6356
  Gene Symbol: FSTL3
  Gene Name: follistatin-like 3 (secreted glycoprotein)
  Uniprot ID: O95633
  ENSP ID: ENSP00000166139
MRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRMLGGRPRCECAPDCSGLPARLQVCGSDGATYRDECELRAARCRGHPDLSVMYRGRCRKSCEHVVCPRPQSCVVDQTGSAHCVVCRAAPCPVPSSPGQELCGNNNVTYISSCHMRQATCFLGRSIGVRHAGSCAGTPEEPPGGESAEEEENFV

SEQ ID NO: 32504 - protein, 40 aa, Homo sapiens
  Payload ID: 6356
  Gene Symbol: FSTL3
  Gene Name: follistatin-like 3 (secreted glycoprotein)
  ENSP ID: ENSP00000466383
MRQATCFLGRSIGVRHAGSCAGTPEEPPGGESAEEEENFV

SEQ ID NO: 32505 - protein, 91 aa, Homo sapiens
  Payload ID: 6356
  Gene Symbol: FSTL3
  Gene Name: follistatin-like 3 (secreted glycoprotein)
  ENSP ID: ENSP00000477770
MRQATCFLGRSIGVRHAGSCAGADAGRGHRPVLGAGEPPALRPQCSYRPLQAPLRSRQVVSLQKRKRTSCEPAGQAWAWCPRPPIIPCYLL

SEQ ID NO: 32506 - protein, 40 aa, Homo sapiens; identical to SEQ ID NO: 32504
  Payload ID: 6356
  Gene Symbol: FSTL3
  Gene Name: follistatin-like 3 (secreted glycoprotein)
  ENSP ID: ENSP00000483064

SEQ ID NO: 32507 - protein, 84 aa, Homo sapiens
  Payload ID: 6356
  Gene Symbol: FSTL3
  Gene Name: follistatin-like 3 (secreted glycoprotein)
  ENSP ID: ENSP00000484376
MLGGRPRCECAPDCSGLPARLQVCGSDGATYRDECELRAARCRGHPDLSVMYRGRCRKSCEHVVCPRPQSCVVDQTGSAHCVVC

SEQ ID NO: 32508 - protein, 40 aa, Homo sapiens; identical to SEQ ID NO: 32504
  Payload ID: 6356
  Gene Symbol: FSTL3
  Gene Name: follistatin-like 3 (secreted glycoprotein)
  ENSP ID: ENSP00000484412

SEQ ID NO: 32509 - protein, 842 aa, Homo sapiens
  Payload ID: 6357
  Gene Symbol: FSTL4
  Gene Name: follistatin-like 4
  Uniprot ID: Q6MZW2
  ENSP ID: ENSP00000265342
MKPGGFWLHLTLLGASLPAALGWMDPGTSRGPDVGVGESQAEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLALQTRLQPLQEGDSRQDPASQKRLLVESLFRDLDADGNGHLSSSELAQHVLKKQDLDEDLLGCSPGDLLRFDDYNSDSSLTLREFYMAFQVVQLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 32510 - protein, 157 aa, Homo sapiens
  Payload ID: 6357
  Gene Symbol: FSTL4
  Gene Name: follistatin-like 4
  ENSP ID: ENSP00000427662
MNPVPQMEMQKSPVFCVAHAGSCRPELFLFGHLGSSWGLDLKEEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLAL

SEQ ID NO: 32511 - protein, 673 aa, Homo sapiens
  Payload ID: 6357
  Gene Symbol: FSTL4
  Gene Name: follistatin-like 4
  Uniprot ID: Q6MZW2
  ENSP ID: ENSP00000484273
MKPGGFWLHLTLLGASLPAALGWMDPGTSRGPDVGVGESQAEEPRSFEVTRREGLSSHNELLASCGKKFCSRGSRCVLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 32512 - protein, 847 aa, Homo sapiens
  Payload ID: 6358
  Gene Symbol: FSTL5
  Gene Name: follistatin-like 5
  Uniprot ID: Q8N475
  ENSP ID: ENSP00000305334
MFKCWSVVLVLGFIFLESEGRPTKEGGYGLKSYQPLMRLRHKQEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 32513 - protein, 846 aa, Homo sapiens
  Payload ID: 6358
  Gene Symbol: FSTL5
  Gene Name: follistatin-like 5
  Uniprot ID: Q8N475
  ENSP ID: ENSP00000368462
MFKCWSVVLVLGFIFLESEGRPTKEGGYGLKSYQPLMRLRHKEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 32514 - protein, 837 aa, Homo sapiens
  Payload ID: 6358
  Gene Symbol: FSTL5
  Gene Name: follistatin-like 5
  Uniprot ID: Q8N475
  ENSP ID: ENSP00000389270
MFKCWSVVLVLGFIFLESEGRPTKEGGYGLKSYQPLMRLRHKEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTRLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 32515 - protein, 537 aa, Homo sapiens
  Payload ID: 6359
  Gene Symbol: FPGS
  Gene Name: folylpolyglutamate synthase
  Uniprot ID: Q05932
  ENSP ID: ENSP00000362322
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 32516 - protein, 375 aa, Homo sapiens
  Payload ID: 6359
  Gene Symbol: FPGS
  Gene Name: folylpolyglutamate synthase
  ENSP ID: ENSP00000362325
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISVLGSQRHPGQGSCGSCPWHLCSSPHPTCGSGFGTRSGRAGRRCCGAGPSPGTWTVRTPPAARRPACAGSARRCRAARGRAVAPRFESCSSMLPGTGTRRPC

SEQ ID NO: 32517 - protein, 587 aa, Homo sapiens
  Payload ID: 6359
  Gene Symbol: FPGS
  Gene Name: folylpolyglutamate synthase
  Uniprot ID: Q05932
  ENSP ID: ENSP00000362344
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 32518 - protein, 561 aa, Homo sapiens
  Payload ID: 6359
  Gene Symbol: FPGS
  Gene Name: folylpolyglutamate synthase
  Uniprot ID: Q05932
  ENSP ID: ENSP00000377309
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 32519 - protein, 264 aa, Homo sapiens
  Payload ID: 6359
  Gene Symbol: FPGS
  Gene Name: folylpolyglutamate synthase
  ENSP ID: ENSP00000400007
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISVLGSQRHPGQGSCGSCPWHLCSSPHPTCGSGFGTRSGRAG

SEQ ID NO: 32520 - protein, 194 aa, Homo sapiens
  Payload ID: 6359
  Gene Symbol: FPGS
  Gene Name: folylpolyglutamate synthase
  ENSP ID: ENSP00000406328
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKVDLAVVEVGIGGAYDCTNIIRKPVVCGVSSLGIDHTSLLGDTVEKIAWQKGGIFKQGVPAFTVLQPEGPLAVLRDRA

SEQ ID NO: 32521 - protein, 375 aa, Homo sapiens; identical to SEQ ID NO: 32516
  Payload ID: 6359
  Gene Symbol: FPGS
  Gene Name: folylpolyglutamate synthase
  ENSP ID: ENSP00000486766

SEQ ID NO: 32522 - protein, 472 aa, Homo sapiens
  Payload ID: 6360
  Gene Symbol: FOXA1
  Gene Name: forkhead box A1
  Uniprot ID: P55317
  ENSP ID: ENSP00000250448
MLGTVKMEGHETSDWNSYYADTQEAYSSVPVSNMNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPAASPQTLDHSGATATGGASELKTPASSTAPPISSGPGALASVPASHPAHGLAPHESQLHLKGDPHYSFNHPFSINNLMSSSEQQHKLDFKAYEQALQYSPYGSTLPASLPLGSASVTTRSPIEPSALEPAYYQGVYSRPVLNTS

SEQ ID NO: 32523 - protein, 36 aa, Homo sapiens
  Payload ID: 6360
  Gene Symbol: FOXA1
  Gene Name: forkhead box A1
  ENSP ID: ENSP00000451704
MLGTVKMEGHETSDWNSYYADTQELAITLQKFNYHY

SEQ ID NO: 32524 - protein, 457 aa, Homo sapiens
  Payload ID: 6361
  Gene Symbol: FOXA2
  Gene Name: forkhead box A2
  Uniprot ID: Q9Y261
  ENSP ID: ENSP00000366319
MLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 32525 - protein, 463 aa, Homo sapiens
  Payload ID: 6361
  Gene Symbol: FOXA2
  Gene Name: forkhead box A2
  Uniprot ID: Q9Y261
  ENSP ID: ENSP00000400341
MHSASSMLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 32526 - protein, 350 aa, Homo sapiens
  Payload ID: 6362
  Gene Symbol: FOXA3
  Gene Name: forkhead box A3
  Uniprot ID: P55318
  ENSP ID: ENSP00000304004
MLGSVKMEAHDLAEWSYYPEAGEVYSPVTPVPTMAPLNSYMTLNPLSSPYPPGGLPASPLPSGPLAPPAPAAPLGPTFPGLGVSGGSSSSGYGAPGPGLVHGKEMPKGYRRPLAHAKPPYSYISLITMAIQQAPGKMLTLSEIYQWIMDLFPYYRENQQRWQNSIRHSLSFNDCFVKVARSPDKPGKGSYWALHPSSGNMFENGCYLRRQKRFKLEEKVKKGGSGAATTTRNGTGSAASTTTPAATVTSPPQPPPPAPEPEAQGGEDVGALDCGSPASSTPYFTGLELPGELKLDAPYNFNHPFSINNLMSEQTPAPPKLDVGFGGYGAEGGEPGVYYQGLYSRSLLNAS

SEQ ID NO: 32527 - protein, 101 aa, Homo sapiens
  Payload ID: 6362
  Gene Symbol: FOXA3
  Gene Name: forkhead box A3
  ENSP ID: ENSP00000470816
MAPLNSYMTLNPLSSPYPPGGLPASPLPSGPLAPPAPAAPLGPTFPGLGVSGGSSSSGYGAPGPGLVHGKEMPKGYRRPLAHAKPPYSYISLITMAIQQAP

SEQ ID NO: 32528 - protein, 325 aa, Homo sapiens
  Payload ID: 6363
  Gene Symbol: FOXB1
  Gene Name: forkhead box B1
  Uniprot ID: Q99853
  ENSP ID: ENSP00000379369
MPRPGRNTYSDQKPPYSYISLTAMAIQSSPEKMLPLSEIYKFIMDRFPYYRENTQRWQNSLRHNLSFNDCFIKIPRRPDQPGKGSFWALHPSCGDMFENGSFLRRRKRFKVLKSDHLAPSKPADAAQYLQQQAKLRLSALAASGTHLPQMPAAAYNLGGVAQPSGFKHPFAIENIIAREYKMPGGLAFSAMQPVPAAYPLPNQLTTMGSSLGTGWPHVYGSAGMIDSATPISMASGDYSAYGVPLKPLCHAAGQTLPAIPVPIKPTPAAVPALPALPAPIPTLLSNSPPSLSPTSSQTATSQSSPATPSETLTSPASALHSVAVH

SEQ ID NO: 32529 - protein, 432 aa, Homo sapiens
  Payload ID: 6364
  Gene Symbol: FOXB2
  Gene Name: forkhead box B2
  Uniprot ID: Q5VYV0
  ENSP ID: ENSP00000365898
MPRPGKSSYSDQKPPYSYISLTAMAIQHSAEKMLPLSDIYKFIMERFPYYREHTQRWQNSLRHNLSFNDCFIKIPRRPDQPGKGSFWALHPDCGDMFENGSFLRRRKRFKVLRADHTHLHAGSTKSAPGAGPGGHLHPHHHHHPHHHHHHHAAAHHHHHHHPPQPPPPPPPPPPHMVHYFHQQPPTAPQPPPHLPSQPPQQPPQQSQPQQPSHPGKMQEAAAVAAAAAAAAAAAVGSVGRLSQFPPYGLGSAAAAAAAAAASTSGFKHPFAIENIIGRDYKGVLQAGGLPLASVMHHLGYPVPGQLGNVVSSVWPHVGVMDSVAAAAAAAAAAGVPVGPEYGAFGVPVKSLCHSASQSLPAMPVPIKPTPALPPVSALQPGLTVPAASQQPPAPSTVCSAAAASPVASLLEPTAPTSAESKGGSLHSVLVHS

SEQ ID NO: 32530 - protein, 553 aa, Homo sapiens
  Payload ID: 6365
  Gene Symbol: FOXC1
  Gene Name: forkhead box C1
  Uniprot ID: Q12948
  ENSP ID: ENSP00000370256
MQARYSVSSPNSLGVVPYLGGEQSYYRAAAAAAGGGYTAMPAPMSVYSHPAHAEQYPGGMARAYGPYTPQPQPKDMVKPPYSYIALITMAIQNAPDKKITLNGIYQFIMDRFPFYRDNKQGWQNSIRHNLSLNECFVKVPRDDKKPGKGSYWTLDPDSYNMFENGSFLRRRRRFKKKDAVKDKEEKDRLHLKEPPPPGRQPPPAPPEQADGNAPGPQPPPVRIQDIKTENGTCPSPPQPLSPAAALGSGSAAAVPKIESPDSSSSSLSSGSSPPGSLPSARPLSLDGADSAPPPPAPSAPPPHHSQGFSVDNIMTSLRGSPQSAAAELSSGLLASAAASSRAGIAPPLALGAYSPGQSSLYSSPCSQTSSAGSSGGGGGGAGAAGGAGGAGTYHCNLQAMSLYAAGERGGHLQGAPGGAGGSAVDDPLPDYSLPPVTSSSSSSLSHGGGGGGGGGGQEAGHHPAAHQGRLTSWYLNQAGGDLGHLASAAAAAAAAGYPGQQQNFHSVREMFESQRIGLNNSPVNGNSSCQMAFPSSQSLYRTSGAFVYDCSKF

SEQ ID NO: 32531 - protein, 501 aa, Homo sapiens
  Payload ID: 6366
  Gene Symbol: FOXC2
  Gene Name: forkhead box C2
  Uniprot ID: Q99958
  ENSP ID: ENSP00000326371
MQARYSVSDPNALGVVPYLSEQNYYRAAGSYGGMASPMGVYSGHPEQYSAGMGRSYAPYHHHQPAAPKDLVKPPYSYIALITMAIQNAPEKKITLNGIYQFIMDRFPFYRENKQGWQNSIRHNLSLNECFVKVPRDDKKPGKGSYWTLDPDSYNMFENGSFLRRRRRFKKKDVSKEKEERAHLKEPPPAASKGAPATPHLADAPKEAEKKVVIKSEAASPALPVITKVETLSPESALQGSPRSAASTPAGSPDGSLPEHHAAAPNGLPGFSVENIMTLRTSPPGGELSPGAGRAGLVVPPLALPYAAAPPAAYGQPCAQGLEAGAAGGYQCSMRAMSLYTGAERPAHMCVPPALDEALSDHPSGPTSPLSALNLAAGQEGALAATGHHHQHHGHHHPQAPPPPPAPQPQPTPQPGAAAAQAASWYLNHSGDLNHLPGHTFAAQQQTFPNVREMFNSHRLGIENSTLGESQVSGNASCQLPYRSTPPLYRHAAPYSYDCTKY

SEQ ID NO: 32532 - protein, 465 aa, Homo sapiens
  Payload ID: 6367
  Gene Symbol: FOXD1
  Gene Name: forkhead box D1
  Uniprot ID: Q16676
  ENSP ID: ENSP00000481581
MTLSTEMSDASGLAEETDIDVVGEGEDEEDEEEEDDDEGGGGGPRLAVPAQRRRRRRSYAGEDELEDLEEEEDDDDILLAPPAGGSPAPPGPAPAAGAGAGGGGGGGGAGGGGSAGSGAKNPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLLPPNAAAAESLLLRGAGAAGGAGDPAAAAALFPPAPPPPPHAYGYGPYGCGYGLQLPPYAPPSALFAAAAAAAAAAAFHPHSPPPPPPPHGAAAELARTAFGYRPHPLGAALPGPLPASAAKAGGPGASALARSPFSIESIIGGSLGPAAAAAAAAQAAAAAQASPSPSPVAAPPAPGSSGGGCAAQAAVGPAAALTRSLVAAAAAAASSVSSSAALGTLHQGTALSSVENFTARISNC

SEQ ID NO: 32533 - protein, 495 aa, Homo sapiens
  Payload ID: 6368
  Gene Symbol: FOXD2
  Gene Name: forkhead box D2
  Uniprot ID: O60548
  ENSP ID: ENSP00000335493
MTLGSCCCEIMSSESSPAALSEADADIDVVGGGSGGGELPARSGPRAPRDVLPHGHEPPAEEAEADLAEDEEESGGCSDGEPRALASRGAAAAAGSPGPGAAAARGAAGPGPGPPSGGAATRSPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLPPPHPHPHPHPELLLRGGAAAAGDPGAFLPGFAAYGAYGYGYGLALPAYGAPPPGPAPHPHPHPHAFAFAAAAAAAPCQLSVPPGRAAAPPPGPPTASVFAGAGSAPAPAPASGSGPGPGPAGLPAFLGAELGCAKAFYAASLSPPAAGTAAGLPTALLRQGLKTDAGGGAGGGGAGAGQRPSFSIDHIMGHGGGGAAPPGAGEGSPGPPFAAAAGPGGQAQVLAMLTAPALAPVAGHIRLSHPGDALLSSGSRFASKVAGLSGCHF

SEQ ID NO: 32534 - protein, 478 aa, Homo sapiens
  Payload ID: 6369
  Gene Symbol: FOXD3
  Gene Name: forkhead box D3
  Uniprot ID: Q9UJU5
  ENSP ID: ENSP00000360157
MTLSGGGSASDMSGQTVLTAEDVDIDVVGEGDDGLEEKDSDAGCDSPAGPPELRLDEADEVPPAAPHHGQPQPPHQQPLTLPKEAAGAGAGPGGDVGAPEADGCKGGVGGEEGGASGGGPGAGSGSAGGLAPSKPKNSLVKPPYSYIALITMAILQSPQKKLTLSGICEFISNRFPYYREKFPAWQNSIRHNLSLNDCFVKIPREPGNPGKGNYWTLDPQSEDMFDNGSFLRRRKRFKRHQQEHLREQTALMMQSFGAYSLAAAAGAAGPYGRPYGLHPAAAAGAYSHPAAAAAAAAAAALQYPYALPPVAPVLPPAVPLLPSGELGRKAAAFGSQLGPGLQLQLNSLGAAAAAAGTAGAAGTTASLIKSEPSARPSFSIENIIGGGPAAPGGSAVGAGVAGGTGGSGGGSTAQSFLRPPGTVQSAALMATHQPLSLSRTTATIAPILSVPLSGQFLQPAASAAAAAAAAAQAKWPAQ

SEQ ID NO: 32535 - protein, 439 aa, Homo sapiens
  Payload ID: 6370
  Gene Symbol: FOXD4
  Gene Name: forkhead box D4
  Uniprot ID: Q12950
  ENSP ID: ENSP00000371940
MNLPRAERLRSTPQRSLRDSDGEDGKIDVLGEEEDEDEEEAASQQFLEQSLQPGLQVARWGGVALPREHIEGGGGPSDPSEFGTEFRAPPRSAAASEDARQPAKPPSSYIALITMAILQSPHKRLTLSGICAFISDRFPYYRRKFPAWQNSIRHNLSLNDCFVKIPREPGRPGKGNYWSLDPASQDMFDNGSFLRRRKRFQRHQPTPGAHLPHPFPLPAAHAALHNPRPGPLLGAPAPPQPVPGAYPNTGPGRRPYALLHPHPPRYLLLSAPAYAGAPKKAEGADLATPAPFPCCSPHLVLSLGRRARVWRRHREADASLSALRVSCKGSGERVQGLRRVCPRPRGATAPCSSDRQACRTILQQQQRHQEEDCANGCAPTKGAVLGGHLSAASALLRYQAVAEGSGLTSLAAPLGGEGTSPVFLVSPTPSSLAESAGPS

SEQ ID NO: 32536 - protein, 408 aa, Homo sapiens
  Payload ID: 6371
  Gene Symbol: FOXD4L1
  Gene Name: forkhead box D4-like 1
  Uniprot ID: Q9NU39
  ENSP ID: ENSP00000302756
MNLPRAERPRSTPQRSLRDSDGEDGKIDVLGEEEDEDEVEDEEEEASQKFLEQSLQPGLQVARWGGVALPREHIEGGGPSDPSEFGTEFRAPPRSAAASEDARQPAKPPYSYIALITMAILQSPHKRLTLSGICAFISGRFPYYRRKFPAWQNSIRHNLSLNDCFVKIPREPGHPGKGTYWSLDPASQDMFDNGSFLRRRKRFKRHQLTPGAHLPHPFPLPAAHAALHNPRPGPLLGAPALPQPVPGAYPNTAPGRRPYALLHPHPPRYLLLSAPAYAGAPKKAEGADLATPGTLPVLQPSLGPQPWEEGKGLASPPGGGCISFSIESIMQGVRGAGTGAAQSLSPTAWSYCPLLQRPSSLSDNFAATAAASGGGLRQRLRSHQGRGAGRAPVGRVGAAAVSGGGRGL

SEQ ID NO: 32537 - protein, 417 aa, Homo sapiens
  Payload ID: 6372
  Gene Symbol: FOXD4L3
  Gene Name: forkhead box D4-like 3
  Uniprot ID: Q6VB84
  ENSP ID: ENSP00000341961
MNLPRAERLRSTPQRSLRDSDGEDGKIDVLGEEEDEDEVEDEEEAASQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPRPGPLLGAPAPPQPVPGAYPNTAPGRRPYALLHPHPLRYLLLSAPVYAGAPKKAEGAALATPAPFPCCSPHLVLSLGRRARVWRRHREADASLSALRVLCKGSGERVQGLRRICPRPRGATATCSSDHQACCIPRPLPLCCKCPPPPLLGQFCSNSSSIRRRTAPTAALPPRARCWAGTCRPRRPC

SEQ ID NO: 32538 - protein, 416 aa, Homo sapiens
  Payload ID: 6373
  Gene Symbol: FOXD4L4
  Gene Name: forkhead box D4-like 4
  Uniprot ID: Q8WXT5
  ENSP ID: ENSP00000366630
MNLPRAERPRSTPQRSLRDSDGEDGKIDVLGEEEDEDEVEDEEEEARQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRRPYALLHPHPLRYLLLSARVYAGAPKKAEGADLATPAPFPCCSPHLVLSLGRRARVWRRHREADASLSALRVLCKGSGERVQGLRRVCPRPRGATATCSSDHQACCIPKPLPLCCKCPPPLLLGQFCSNSSSIRRTAPTAALPPRARCWAGTCRPRRRC

SEQ ID NO: 32539 - protein, 416 aa, Homo sapiens
  Payload ID: 6374
  Gene Symbol: FOXD4L5
  Gene Name: forkhead box D4-like 5
  Uniprot ID: Q5VV16
  ENSP ID: ENSP00000366637
MNLPRAERPRSTPQRSLRDSDGEDGKIDVLGEEEDEDEVEDEEEEARQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRCPYALLHPHPLRYLLLSAPVYAGAPKKAEGADLATPAPFPCCSPHLVLSLGRRARVWRRHREADASLSALRVLCKGSGERVQGLRRVCPRPRGATATCSSDHQACCIPKPLPLCCKCPPPLLLGQFCSNSSSIRRTAPTAALPPRARCWAGTCRPRRRC

SEQ ID NO: 32540 - protein, 417 aa, Homo sapiens
  Payload ID: 6375
  Gene Symbol: FOXD4L6
  Gene Name: forkhead box D4-like 6
  Uniprot ID: Q3SYB3
  ENSP ID: ENSP00000484875
MNLPRAERLRSTPQRSLRDSDGEDGKIDVLGEEEDEDEVEDEEEAASQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRRPYALLHPHPLRYLLLSAPVYAGAPKKAEGAALATPAPFPCCSPHLVLSLGRRARVWRRHREADASLSALRVLCKGSGERVQGLRRVCPRPRGATATCSSDHQACCIPRPLPLCCKCPPPPLLGQFCSNSSSIRRRTAPTAALPPRARCWAGTCRPRRPC

SEQ ID NO: 32541 - protein, 373 aa, Homo sapiens
  Payload ID: 6376
  Gene Symbol: FOXE1
  Gene Name: forkhead box E1
  Uniprot ID: O00358
  ENSP ID: ENSP00000364265
MTAESGPPPPQPEVLATVKEERGETAAGAGVPGEATGRGAGGRRRKRPLQRGKPPYSYIALIAMAIAHAPERRLTLGGIYKFITERFPFYRDNPKKWQNSIRHNLTLNDCFLKIPREAGRPGKGNYWALDPNAEDMFESGSFLRRRKRFKRSDLSTYPAYMHDAAAAAAAAAAAAAAAAIFPGAVPAARPPYPGAVYAGYAPPSLAAPPPVYYPAASPGPCRVFGLVPERPLSPELGPAPSGPGGSCAFASAGAPATTTGYQPAGCTGARPANPSAYAAAYAGPDGAYPQGAGSAIFAAAGRLAGPASPPAGGSSGGVETTVDFYGRTSPGQFGALGACYNPGGQLGGASAGAYHARHAAAYPGGIDRFVSAM

SEQ ID NO: 32542 - protein, 319 aa, Homo sapiens
  Payload ID: 6377
  Gene Symbol: FOXE3
  Gene Name: forkhead box E3
  Uniprot ID: Q13461
  ENSP ID: ENSP00000334472
MAGRSDMDPPAAFSGFPALPAVAPSGPPPSPLAGAEPGREPEEAAAGRGEAAPTPAPGPGRRRRRPLQRGKPPYSYIALIAMALAHAPGRRLTLAAIYRFITERFAFYRDSPRKWQNSIRHNLTLNDCFVKVPREPGNPGKGNYWTLDPAAADMFDNGSFLRRRKRFKRAELPAHAAAAPGPPLPFPYAPYAPAPGPALLVPPPSAGPGPSPPARLFSVDSLVNLQPELAGLGAPEPPCCAAPDAAAAAFPPCAAAASPPLYSQVPDRLVLPATRPGPGPLPAEPLLALAGPAAALGPLSPGEAYLRQPGFASGLERYL

SEQ ID NO: 32543 - protein, 379 aa, Homo sapiens
  Payload ID: 6378
  Gene Symbol: FOXF1
  Gene Name: forkhead box F1
  Uniprot ID: Q12946
  ENSP ID: ENSP00000262426
MSSAPEKQQPPHGGGGGGGGGGGAAMDPASSGPSKAKKTNAGIRRPEKPPYSYIALIVMAIQSSPTKRLTLSEIYQFLQSRFPFFRGSYQGWKNSVRHNLSLNECFIKLPKGLGRPGKGHYWTIDPASEFMFEEGSFRRRPRGFRRKCQALKPMYSMMNGLGFNHLPDTYGFQGSAGGLSCPPNSLALEGGLGMMNGHLPGNVDGMALPSHSVPHLPSNGGHSYMGGCGGAAAGEYPHHDSSVPASPLLPTGAGGVMEPHAVYSGSAAAWPPSASAALNSGASYIKQQPLSPCNPAANPLSGSLSTHSLEQPYLHQNSHNAPAELQGIPRYHSQSPSMCDRKEFVFSFNAMASSSMHSAGGGSYYHQQVTYQDIKPCVM

SEQ ID NO: 32544 - protein, 444 aa, Homo sapiens
  Payload ID: 6379
  Gene Symbol: FOXF2
  Gene Name: forkhead box F2
  Uniprot ID: Q12947
  ENSP ID: ENSP00000259806
MTTEGGPPPAPLRRACSPVPGALQAALMSPPPAAAAAAAAAPETTSSSSSSSSASCASSSSSSNSASAPSAACKSAGGGGAGAGSGGAKKASSGLRRPEKPPYSYIALIVMAIQSSPSKRLTLSEIYQFLQARFPFFRGAYQGWKNSVRHNLSLNECFIKLPKGLGRPGKGHYWTIDPASEFMFEEGSFRRRPRGFRRKCQALKPMYHRVVSGLGFGASLLPQGFDFQAPPSAPLGCHSQGGYGGLDMMPAGYDAGAGAPSHAHPHHHHHHHVPHMSPNPGSTYMASCPVPAGPGGVGAAGGGGGGDYGPDSSSSPVPSSPAMASAIECHSPYTSPAAHWSSPGASPYLKQPPALTPSSNPAASAGLHSSMSSYSLEQSYLHQNAREDLSVGLPRYQHHSTPVCDRKDFVLNFNGISSFHPSASGSYYHHHHQSVCQDIKPCVM

SEQ ID NO: 32545 - protein, 489 aa, Homo sapiens [sequence omitted]

SEQ ID NO: 32546 - protein, 365 aa, Homo sapiens
  Payload ID: 6381
  Gene Symbol: FOXH1
  Gene Name: forkhead box H1
  Uniprot ID: O75593
  ENSP ID: ENSP00000366534
MGPCSGSRLGPPEAESPSQPPKRRKKRYLRHDKPPYTYLAMIALVIQAAPSRRLKLAQIIRQVQAVFPFFREDYEGWKDSIRHNLSSNRCFRKVPKDPAKPQAKGNFWAVDVSLIPAEALRLQNTALCRRWQNGGARGAFAKDLGPYVLHGRPYRPPSPPPPPSEGFSIKSLLGGSGEGAPWPGLAPQSSPVPAGTGNSGEEAVPTPPLPSSERPLWPLCPLPGPTRVEGETVQGGAIGPSTLSPEPRAWPLHLLQGTAVPGGRSSGGHRASLWGQLPTSYLPIYTPNVVMPLAPPPTSCPQCPSTSPAYWGVAPETRGPPGLLCDLDALFQGVPPNKSIYDVWVSHPRDLAAPGPGWLLSWCSL

SEQ ID NO: 32547 - protein, 378 aa, Homo sapiens
  Payload ID: 6382
  Gene Symbol: FOXI1
  Gene Name: forkhead box I1
  Uniprot ID: Q12951
  ENSP ID: ENSP00000304286
MSSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPGKGNYWTLDPNCEKMFDNGNFRRKRKRKSDVSSSTASLALEKTESSLPVDSPKTTEPQDILDGASPGGTTSSPEKRPSPPPSGAPCLNSFLSSMTAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 32548 - protein, 283 aa, Homo sapiens
  Payload ID: 6382
  Gene Symbol: FOXI1
  Gene Name: forkhead box I1
  Uniprot ID: Q12951
  ENSP ID: ENSP00000415483
MSSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 32549 - protein, 318 aa, Homo sapiens
  Payload ID: 6383
  Gene Symbol: FOXI2
  Gene Name: forkhead box I2
  Uniprot ID: Q6ZQN5
  ENSP ID: ENSP00000373572
MATYCDDLGPSSAPPGQAQATAHPPGYEPGDLGAVGGGPLLWVNAPALSPKSYASGPGPAPPYAAPSYGAPGPLLGAPGGLAGADLAWLSLSGQQELLRLVRPPYSYSALIAMAIQSAPLRKLTLSQIYQYVAGNFPFYKRSKAGWQNSIRHNLSLNDCFKKVPRDEDDPGKGNYWTLDPNCEKMFDNGNFRRKRKRRAEASAAVRSGARSVGGAEAPALEPPSAACLDLQASPSPSAPEAATCFSGFASAMSALAGGLGTFPGGLAGDFSFGRRPPTVATHAPQTLNPSPGFAPGHQTAAAGFRLSHLLYSREGTEV

SEQ ID NO: 32550 - protein, 420 aa, Homo sapiens
  Payload ID: 6384
  Gene Symbol: FOXI3
  Gene Name: forkhead box I3
  Uniprot ID: A8MTJ6
  ENSP ID: ENSP00000478384
MALYCGDNFGVYSQPGLPPPAATAAAPGAPPAARAPYGLADYAAPPAAAANPYLWLNGPGVGGPPSAAAAAAAAYLGAPPPPPPPGAAAGPFLQPPPAAGTFGCSQRPFAQPAPAAPASPAAPAGPGELGWLSMASREDLMKMVRPPYSYSALIAMAIQSAPERKLTLSHIYQFVADSFPFYQRSKAGWQNSIRHNLSLNDCFKKVPRDEDDPGKGNYWTLDPNCEKMFDNGNFRRKRKRRSEASNGSTVAAGTSKSEEGLSSGLGSGVGGKPEEESPSTLLRPSHSPEPPEGTKSTASSPGGPMLTSTPCLNTFFSSLSSLSVSSSVSTQRALPGSRHLGIQGAQLPSSGVFSPTSISEASADTLQLSNSTSNSTGQRSSYYSPFPASTSGGQSSPFSSPFHNFSMVNSLIYPREGSEV

SEQ ID NO: 32551 - protein, 421 aa, Homo sapiens
  Payload ID: 6385
  Gene Symbol: FOXJ1
  Gene Name: forkhead box J1
  Uniprot ID: Q92949
  ENSP ID: ENSP00000323880
MAESWLRLSGAGPAEEAGPEGGLEEPDALDDSLTSLQWLQEFSILNAKAPALPPGGTDPHGYHQVPGSAAPGSPLAADPACLGQPHTPGKPTSSCTSRSAPPGLQAPPPDDVDYATNPHVKPPYSYATLICMAMQASKATKITLSAIYKWITDNFCYFRHADPTWQNSIRHNLSLNKCFIKVPREKDEPGKGGFWRIDPQYAERLLSGAFKKRRLPPVHIHPAFARQAAQEPSAVPRAGPLTVNTEAQQLLREFEEATGEAGWGAGEGRLGHKRKQPLPKRVAKVPRPPSTLLPTPEEQGELEPLKGNFDWEAIFDAGTLGGELGALEALELSPPLSPASHVDVDLTIHGRHIDCPATWGPSVEQAADSLDFDETFLATSFLQHPWDESGSGCLPPEPLFEAGDATLASDLQDWASVGAFL

SEQ ID NO: 32552 - protein, 574 aa, Homo sapiens
  Payload ID: 6386
  Gene Symbol: FOXJ2
  Gene Name: forkhead box J2
  Uniprot ID: Q9P0K8
  ENSP ID: ENSP00000162391
MASDLESSLTSIDWLPQLTLRATIEKLGSASQAGPPGSSRKCSPGSPTDPNATLSKDEAAVHQDGKPRYSYATLITYAINSSPAKKMTLSEIYRWICDNFPYYKNAGIGWKNSIRHNLSLNKCFRKVPRPRDDPGKGSYWTIDTCPDISRKRRHPPDDDLSQDSPEQEASKSPRGGVAGSGEASLPPEGNPQMSLQSPTSIASYSQGTGSVDGGAVAAGASGRESAEGPPPLYNTNHDFKFSYSEINFQDLSWSFRNLYKSMLEKSSSSSQHGFSSLLGDIPPSNNYYMYQQQQPPPPQQQQQQQQPPQPPPQQSQPQQQQAPAQGPSAVGGAPPLHTPSTDGCTPPGGKQAGAEGYGPPPVMAMHPPPLQHGGYHPHQHHPHSHPAQQPPPPQPQAQGQAPINNTGFAFPSDWCSNIDSLKESFKMVNRLNWSSIEQSQFSELMESLRQAEQKNWTLDQHHIANLCDSLNHFLTQTGHVPPQGGTHRPPAPARIADSCALTSGKQESAMSQVNSYGHPQAPHLYPGPSPMYPIPTQDSAGYNRPAHHMVPRPSVPPPGANEEIPDDFDWDLIT

SEQ ID NO: 32553 - protein, 526 aa, Homo sapiens
  Payload ID: 6386
  Gene Symbol: FOXJ2
  Gene Name: forkhead box J2
  Uniprot ID: Q9P0K8
  ENSP ID: ENSP00000403411
MASDLESSLTSIDWLPQLTLRATIEKLGSASQAGPPGSSRKCSPGSPTDPNATLSKDEAAVHQDGKPRYSYATLITYAINSSPAKKMTLSEIYRWICDNFPYYKNAGIGWKNSIRHNLSLNKCFRKVPRPRDDPGKGSYWTIDTCPDISRKRRHPPDDDLSQDSPEQEASKSPRGGVAGSGEASLPPEGNPQMSLQSPTSIASYSQGTGSVDGGAVAAGASGRESAEGPPPLYNTNHDFKFSYSEINFQDLSWSFRNLYKSMLEKSSSSSQHGFSSLLGDIPPSNNYYMYQQQQPPPPQQQQQQQQPPQPPPQQSQPQQQQAPAQGPSAVGGAPPLHTPSTDGCTPPGGKQAGAEGYGPPPVMAMHPPPLQHGGYHPHQHHPHSHPAQQPPPPQPQAQGQAPINNTGFAFPSDWCSNIDSLKESFKMVNRLNWSSIEQSQFSELMESLRQAEQKNWTLDQHHIANLCDSLNHFLTQTGHVPPQGGTHRPPAPARIADSCALTSGKQESAMSQGTAPSQLPWRWRLC

SEQ ID NO: 32554 - protein, 588 aa, Homo sapiens
  Payload ID: 6387
  Gene Symbol: FOXJ3
  Gene Name: forkhead box J3
  Uniprot ID: Q9UPW0
  ENSP ID: ENSP00000354449
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDVLPTRPKKRARSVERVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 32555 - protein, 622 aa, Homo sapiens
  Payload ID: 6387
  Gene Symbol: FOXJ3
  Gene Name: forkhead box J3
  Uniprot ID: Q9UPW0
  ENSP ID: ENSP00000354620
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDVLPTRPKKRARSVERASTPYSIDSDSLGMECIISGSASPTLAINTVTNKVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 32556 - protein, 136 aa, Homo sapiens
  Payload ID: 6387
  Gene Symbol: FOXJ3
  Gene Name: forkhead box J3
  ENSP ID: ENSP00000361652
MESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 32557 - protein, 622 aa, Homo sapiens; identical to SEQ ID NO: 32555
  Payload ID: 6387
  Gene Symbol: FOXJ3
  Gene Name: forkhead box J3
  Uniprot ID: Q9UPW0
  ENSP ID: ENSP00000361653

SEQ ID NO: 32558 - protein, 622 aa, Homo sapiens; identical to SEQ ID NO: 32555
  Payload ID: 6387
  Gene Symbol: FOXJ3
  Gene Name: forkhead box J3
  Uniprot ID: Q9UPW0
  ENSP ID: ENSP00000361654

SEQ ID NO: 32559 - protein, 86 aa, Homo sapiens
  Payload ID: 6387
  Gene Symbol: FOXJ3
  Gene Name: forkhead box J3
  ENSP ID: ENSP00000388099
MECIISGSASPTLAINTVTNKVTLYNTDQDGSDSPRSSLNNSLSDQSLASVNLNSVGSVHSYTPVTSHPESVSQSLTPQQQPQYNL

SEQ ID NO: 32560 - protein, 382 aa, Homo sapiens
  Payload ID: 6387
  Gene Symbol: FOXJ3
  Gene Name: forkhead box J3
  ENSP ID: ENSP00000393408
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDVLPTRPKKRARSVERVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQ

SEQ ID NO: 32561 - protein, 125 aa, Homo sapiens
  Payload ID: 6387
  Gene Symbol: FOXJ3
  Gene Name: forkhead box J3
  ENSP ID: ENSP00000403060
ATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKVGFIFLKQLNSSVCHLSCLN

SEQ ID NO: 32562 - protein, 622 aa, Homo sapiens; identical to SEQ ID NO: 32555
  Payload ID: 6387
  Gene Symbol: FOXJ3
  Gene Name: forkhead box J3
  Uniprot ID: Q9UPW0
  ENSP ID: ENSP00000439044

SEQ ID NO: 32563 - protein, 733 aa, Homo sapiens
  Payload ID: 6388
  Gene Symbol: FOXK1
  Gene Name: forkhead box K1
  Uniprot ID: P85037
  ENSP ID: ENSP00000328720
MAEVGEDSGARALLALRSAPCSPVLCAAAAAAAFPAAAPPPAPAQPQPPPGPPPPPPPPLPPGAIAGAGSSGGSSGVSGDSAVAGAAPALVAAAAASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 32564 - protein, 109 aa, Homo sapiens
  Payload ID: 6388
  Gene Symbol: FOXK1
  Gene Name: forkhead box K1
  ENSP ID: ENSP00000475486
  MOD_RES (1)..(1): Any amino acid
XTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKV

SEQ ID NO: 32565 - protein, 660 aa, Homo sapiens
  Payload ID: 6389
  Gene Symbol: FOXK2
  Gene Name: forkhead box K2
  Uniprot ID: Q01167
  ENSP ID: ENSP00000335677
MAAAAAALSGAGTPPAGGGAGGGGAGGGGSPPGGWAVARLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVREKGVQN

SEQ ID NO: 32566 - protein, 253 aa, Homo sapiens
  Payload ID: 6389
  Gene Symbol: FOXK2
  Gene Name: forkhead box K2
  ENSP ID: ENSP00000432663
MAEPLGIQAPCPVCVHLVLPCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPAS

SEQ ID NO: 32567 - protein, 172 aa, Homo sapiens
  Payload ID: 6389
  Gene Symbol: FOXK2
  Gene Name: forkhead box K2
  ENSP ID: ENSP00000433167
MAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTP

SEQ ID NO: 32568 - protein, 614 aa, Homo sapiens
  Payload ID: 6389
  Gene Symbol: FOXK2
  Gene Name: forkhead box K2
  Uniprot ID: Q01167
  ENSP ID: ENSP00000436108
MAAAAAALSGAGTPPAGGGAGGGGAGGGGSPPGGWAVARLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNGPLGLRRPPCASSDWSCLS

SEQ ID NO: 32569 - protein, 129 aa, Homo sapiens
  Payload ID: 6389
  Gene Symbol: FOXK2
  Gene Name: forkhead box K2
  ENSP ID: ENSP00000461540
  MOD_RES (1)..(1): Any amino acid
XTPAAVLAPPKAEAQENGDHREVKVKVEPIPAIGHATLGTASRIIQTAQTTPVQTVTIVQQAPLGQHQLPIKTVTQNGTHVASVPTAVHGQVNNGKTCWSVAPRGCGYWEQSPFSLVVSVLTVTILAFV

SEQ ID NO: 32570 - protein, 610 aa, Homo sapiens
  Payload ID: 6389
  Gene Symbol: FOXK2
  Gene Name: forkhead box K2
  ENSP ID: ENSP00000481132
MAAARRALGAGTPRARGRGRGAGGGGSRRALGRGAPGGPRVRVSDEEALGDHRPQLVAGLGGREHGPLELHLPAPPRDLHAPGRRGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNGPLGLRRPPCASSDWSCLS

SEQ ID NO: 32571 - protein, 345 aa, Homo sapiens
  Payload ID: 6390
  Gene Symbol: FOXL1
  Gene Name: forkhead box L1
  Uniprot ID: Q12952
  ENSP ID: ENSP00000326272
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREKGRPGKGSYWTLDPRCLDMFENGNYRRRKRKPKPGPGAPEAKRPRAETHQRSAEAQPEAGSGAGGSGPAISRLQAAPAGPSPLLDGPSPPAPLHWPGTASPNEDAGDAAQGAAAVAVGQAARTGDGPGSPLRPASRSSPKSSDKSKSFSIDSILAGKQGQKPPSGDELLGGAKPGPGGRLGASLLAASSSLRPPFNASLMLDPHVQGGFYQLGIPFLSYFPLQVPDTVLHFQ

SEQ ID NO: 32572 - protein, 114 aa, Homo sapiens
  Payload ID: 6390
  Gene Symbol: FOXL1
  Gene Name: forkhead box L1
  ENSP ID: ENSP00000472376
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREK

SEQ ID NO: 32573 - protein, 376 aa, Homo sapiens
  Payload ID: 6391
  Gene Symbol: FOXL2
  Gene Name: forkhead box L2
  Uniprot ID: P58012
  ENSP ID: ENSP00000333188
MMASYPEPEDAAGALLAPETGRTVKEPEGPPPSPGKGGGGGGGTAPEKPDPAQKPPYSYVALIAMAIRESAEKRLTLSGIYQYIIAKFPFYEKNKKGWQNSIRHNLSLNECFIKVPREGGGERKGNYWTLDPACEDMFEKGNYRRRRRMKRPFRPPPAHFQPGKGLFGAGGAAGGCGVAGAGADGYGYLAPPKYLQSGFLNNSWPLPQPPSPMPYASCQMAAAAAAAAAAAAAAGPGSPGAAAVVKGLAGPAASYGPYTRVQSMALPPGVVNSYNGLGGPPAAPPPPPHPHPHPHAHHLHAAAAPPPAPPHHGAAAPPPGQLSPASPATAAPPAPAPTSAPGLQFACARQPELAMMHCSYWDHDSKTGALHSRLDL

SEQ ID NO: 32574 - protein, 801 aa, Homo sapiens
  Payload ID: 6392
  Gene Symbol: FOXM1
  Gene Name: forkhead box M1
  Uniprot ID: Q08050
  ENSP ID: ENSP00000342307
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVFGEQVVFGYMSKFFSGDLRDFGTPITSLFNFIFLCLSVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 32575 - protein, 763 aa, Homo sapiens
  Payload ID: 6392
  Gene Symbol: FOXM1
  Gene Name: forkhead box M1
  Uniprot ID: Q08050
  ENSP ID: ENSP00000352901
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 32576 - protein, 748 aa, Homo sapiens
  Payload ID: 6392
  Gene Symbol: FOXM1
  Gene Name: forkhead box M1
  Uniprot ID: Q08050
  ENSP ID: ENSP00000354492
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 32577 - protein, 206 aa, Homo sapiens
  Payload ID: 6392
  Gene Symbol: FOXM1
  Gene Name: forkhead box M1
  ENSP ID: ENSP00000442309
  MOD_RES (1)..(1): Any amino acid
XAKPGWKNSIRHNLSLHDMFVRETSANGKVSFWTIHPSANRYLTLDQVFKPLDPGSPQLPEHLESQQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVE

SEQ ID NO: 32578 - protein, 80 aa, Homo sapiens
  Payload ID: 6392
  Gene Symbol: FOXM1
  Gene Name: forkhead box M1
  ENSP ID: ENSP00000444541
TALTAKGKESGSSGPNKFILISCGGAPTQPPGLRPQTQTSYDAKRTEVTLETLGPKPAARDVNLPRPPGALCEQKRETCG

SEQ ID NO: 32579 - protein, 748 aa, Homo sapiens
  Payload ID: 6392
  Gene Symbol: FOXM1
  Gene Name: forkhead box M1
  ENSP ID: ENSP00000486536
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCDGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKQQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 32580 - protein, 648 aa, Homo sapiens
  Payload ID: 6393
  Gene Symbol: FOXN1
  Gene Name: forkhead box N1
  Uniprot ID: O15353
  ENSP ID: ENSP00000226247
MVSLPPPQSDVTLPGPTRLEGERQGDLMQAPGLPGSPAPQSKHAGFSCSSFVSDGPPERTPSLPPHSPRIASPGPEQVQGHCPAGPGPGPFRLSPSDKYPGFGFEEAAASSPGRFLKGSHAPFHPYKRPFHEDVFPEAETTLALKGHSFKTPGPLEAFEEIPVDVAEAEAFLPGFSAEAWCNGLPYPSQEHGPQVLGSEVKVKPPVLESGAGMFCYQPPLQHMYCSSQPPFHQYSPGGGSYPIPYLGSSHYQYQRMAPQASTDGHQPLFPKPIYSYSILIFMALKNSKTGSLPVSEIYNFMTEHFPYFKTAPDGWKNSVRHNLSLNKCFEKVENKSGSSSRKGCLWALNPAKIDKMQEELQKWKRKDPIAVRKSMAKPEELDSLIGDKREKLGSPLLGCPPPGLSGSGPIRPLAPPAGLSPPLHSLHPAPGPIPGKNPLQDLLMGHTPSCYGQTYLHLSPGLAPPGPPQPLFPQPDGHLELRAQPGTPQDSPLPAHTPPSHSAKLLAEPSPARTMHDTLLPDGDLGTDLDAINPSLTDFDFQGNLWEQLKDDSLALDPLVLVTSSPTSSSMPPPQPPPHCFPPGPCLTETGSGAGDLAAPGSGGSGALGDLHLTTLYSAFMELEPTPPTAPAGPSVYLSPSSKPVALA

SEQ ID NO: 32581 - protein, 117 aa, Homo sapiens
  Payload ID: 6393
  Gene Symbol: FOXN1
  Gene Name: forkhead box N1
  ENSP ID: ENSP00000462159
MVSLPPPQSDVTLPGPTRLEGERQGDLMQAPGLPGSPAPQSKHAGFSCSSFVSDGPPERTPSLPPHSPRIASPGPEQVQGHCPAGPGPGPFRLSPSDKYPGFGFEEAAASSPGRFLK

SEQ ID NO: 32582 - protein, 648 aa, Homo sapiens; identical to SEQ ID NO: 32580
  Payload ID: 6393
  Gene Symbol: FOXN1
  Gene Name: forkhead box N1
  Uniprot ID: O15353
  ENSP ID: ENSP00000464645

SEQ ID NO: 32583 - protein, 431 aa, Homo sapiens
  Payload ID: 6394
  Gene Symbol: FOXN2
  Gene Name: forkhead box N2
  Uniprot ID: P32314
  ENSP ID: ENSP00000343633
MGPVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGILECEKPLPLKTALQKKRSYGNAFHHPSAVRLQESDSLATSIDPKEDHNYSASSMAAQRCASRSSVSSLSSVDEVYEFIPKNSHVGSDGSEGFHSEEDTDVDYEDDPLGDSGYASQPCAKISEKGQSGKKMRKQTCQEIDEELKEAAGSLLHLAGIRTCLGSLISTAKTQNQKQRKK

SEQ ID NO: 32584 - protein, 246 aa, Homo sapiens
  Payload ID: 6394
  Gene Symbol: FOXN2
  Gene Name: forkhead box N2
  ENSP ID: ENSP00000388486
MGPVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMML

SEQ ID NO: 32585 - protein, 340 aa, Homo sapiens
  Payload ID: 6394
  Gene Symbol: FOXN2
  Gene Name: forkhead box N2
  ENSP ID: ENSP00000484534
MMCHPLDQLATRTQKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGILECEKPLPLKTALQKKRSYGNAFHHPSAVRLQESDSLATSIDPKEDHNYSASSMAAQRCASRSSVSSLSSVDEVYEFIPKNSHVGSDGSEGFHSEEDTDVDYEDDPLGDSGYASQPCAKISEKGQSGKKMRKQTCQEIDEELKEAAGSLLHLAGIRTCLGSLISTAKTQNQKQRKK

SEQ ID NO: 32586 - protein, 490 aa, Homo sapiens
  Payload ID: 6395
  Gene Symbol: FOXN3
  Gene Name: forkhead box N3
  Uniprot ID: O00409
  ENSP ID: ENSP00000261302
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQDPDIDAASAMMLLNTPPEIQAGFPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 32587 - protein, 490 aa, Homo sapiens; identical to SEQ ID NO: 32586
  Payload ID: 6395
  Gene Symbol: FOXN3
  Gene Name: forkhead box N3
  Uniprot ID: O00409
  ENSP ID: ENSP00000343288

SEQ ID NO: 32588 - protein, 111 aa, Homo sapiens
  Payload ID: 6395
  Gene Symbol: FOXN3
  Gene Name: forkhead box N3
  ENSP ID: ENSP00000450684
  MOD_RES (1)..(1): Any amino acid
XYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQEK

SEQ ID NO: 32589 - protein, 79 aa, Homo sapiens
  Payload ID: 6395
  Gene Symbol: FOXN3
  Gene Name: forkhead box N3
  ENSP ID: ENSP00000450783
RPLPITPIGVTAAMRQSVYTMIHLCDSSSQTYIVPELSATSIFLHLPLLGERRNSSVESIIIQRTCRNLSQQHKLQDQA

SEQ ID NO: 32590 - protein, 185 aa, Homo sapiens
  Payload ID: 6395
  Gene Symbol: FOXN3
  Gene Name: forkhead box N3
  ENSP ID: ENSP00000450833
  MOD_RES (1)..(1): Any amino acid
XANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQDPDIDAASAMMLLNTPPEIQAVPPGVIQNGARVLSRGLFPGVRPLPITPIGVTAAMRNGITSCRMRTESEPSCGSPVVSGDPKEDHN

SEQ ID NO: 32591 - protein, 91 aa, Homo sapiens
  Payload ID: 6395
  Gene Symbol: FOXN3
  Gene Name: forkhead box N3
  ENSP ID: ENSP00000451024
FPYFANAPTGWKNSVRHNLSLNKCFKKVDKERSQSIGKGSLWCIDPEYRQNLIQALKKTPYHPHPHVFNTPPTCPQAYQRDGVSPSWPGWS

SEQ ID NO: 32592 - protein, 208 aa, Homo sapiens
  Payload ID: 6395
  Gene Symbol: FOXN3
  Gene Name: forkhead box N3
  ENSP ID: ENSP00000451135
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPY

SEQ ID NO: 32593 - protein, 76 aa, Homo sapiens
  Payload ID: 6395
  Gene Symbol: FOXN3
  Gene Name: forkhead box N3
  ENSP ID: ENSP00000451437
APTGWKNSVRHNLSLNKCFKKVDKERSQSIGKGSLWCIDPEYRQNLIQALKKTPYHPHPHVFNTPPTCPQAYQREG

SEQ ID NO: 32594 - protein, 54 aa, Homo sapiens
  Payload ID: 6395
  Gene Symbol: FOXN3
  Gene Name: forkhead box N3
  ENSP ID: ENSP00000451902
MGPVMPPSKKPESSGISVSSGLSQCYGGSGFSKALQEDDDLDFSLPDIRLEEGA

SEQ ID NO: 32595 - protein, 468 aa, Homo sapiens
  Payload ID: 6395
  Gene Symbol: FOXN3
  Gene Name: forkhead box N3
  Uniprot ID: O00409
  ENSP ID: ENSP00000452005
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQVPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 32596 - protein, 468 aa, Homo sapiens; identical to SEQ ID NO: 32595
  Payload ID: 6395
  Gene Symbol: FOXN3
  Gene Name: forkhead box N3
  Uniprot ID: O00409
  ENSP ID: ENSP00000452227

SEQ ID NO: 32597 - protein, 93 aa, Homo sapiens
  Payload ID: 6395
  Gene Symbol: FOXN3
  Gene Name: forkhead box N3
  ENSP ID: ENSP00000452290
MGPVMPPSKKPESSGISVSSGLSQCYGGSGFSKALQEDDDLDFSLPDIRLEEGAMEDEELTNLNWLHESKNLLKSFGESVLRSVSPVQDLDDD

SEQ ID NO: 32598 - protein, 122 aa, Homo sapiens
  Payload ID: 6395
  Gene Symbol: FOXN3
  Gene Name: forkhead box N3
  ENSP ID: ENSP00000452444
SHVSADSNRGYSRGGRKVPNLQESRYREPGTESIGKGSLWCIDPEYRQNLIQALKKTPYHPHPHVFNTPPTCPQAYQSTSGPPIWPGSTFFKRNGALLQDPDIDAASAMMLLNTPPEIQAGC

SEQ ID NO: 32599 - protein, 468 aa, Homo sapiens; identical to SEQ ID NO: 32595
  Payload ID: 6395
  Gene Symbol: FOXN3
  Gene Name: forkhead box N3
  Uniprot ID: O00409
  ENSP ID: ENSP00000479114

SEQ ID NO: 32600 - protein, 517 aa, Homo sapiens
  Payload ID: 6396
  Gene Symbol: FOXN4
  Gene Name: forkhead box N4
  Uniprot ID: Q96NZ1
  ENSP ID: ENSP00000299162
MIESDTSSIMSGIIRNSGQNHHPSPQEYRLLATTSDDDLPGDLQSLSWLTAVDVPRLQQMASGRVDLGGPCVPHPHPGALAGVADLHVGATPSPLLHGPAGMAPRGMPGLGPITGHRDSMSQFPVGGQPSSGLQDPPHLYSPATQPQFPLPPGAQQCPPVGLYGPPFGVRPPYPQPHVAVHSSQELHPKHYPKPIYSYSCLIAMALKNSKTGSLPVSEIYSFMKEHFPYFKTAPDGWKNSVRHNLSLNKCFEKVENKMSGSSRKGCLWALNLARIDKMEEEMHKWKRKDLAAIHRSMANPEELDKLISDRPESCRRPGKPGEPEAPVLTHATTVAVAHGCLAVSQLPPQPLMTLSLQSVPLHHQVQPQAHLAPDSPAPAQTPPLHALPDLSPSPLPHPAMGRAPVDFINISTDMNTEVDALDPSIMDFALQGNLWEEMKDEGFSLDTLGAFADSPLGCDLGASGLTPASGGSDQSFPDLQVTGLYTAYSTPDSVAASGTSSSSQYLGAQGNKPIALL

SEQ ID NO: 32601 - protein, 337 aa, Homo sapiens
  Payload ID: 6396
  Gene Symbol: FOXN4
  Gene Name: forkhead box N4
  Uniprot ID: Q96NZ1
  ENSP ID: ENSP00000347354
MPGLPCPALPCPAPPPAPSCLIAMALKNSKTGSLPVSEIYSFMKEHFPYFKTAPDGWKNSVRHNLSLNKCFEKVENKMSGSSRKGCLWALNLARIDKMEEEMHKWKRKDLAAIHRSMANPEELDKLISDRPESCRRPGKPGEPEAPVLTHATTVAVAHGCLAVSQLPPQPLMTLSLQSVPLHHQVQPQAHLAPDSPAPAQTPPLHALPDLSPSPLPHPAMGRAPVDFINISTDMNTEVDALDPSIMDFALQGNLWEEMKDEGFSLDTLGAFADSPLGCDLGASGLTPASGGSDQSFPDLQVTGLYTAYSTPDSVAASGTSSSSQYLGAQGNKPIALL

SEQ ID NO: 32602 - protein, 218 aa, Homo sapiens
  Payload ID: 6396
  Gene Symbol: FOXN4
  Gene Name: forkhead box N4
  ENSP ID: ENSP00000408085
GDLQSLSWLTAVDVPRLQQMASGRVDLGGPCVPHPHPGALAGVADLHVGATPSPLLHGPAGMAPRGMPGLGPITGHRDSQMSQFPVGGQPSSGLQDPPHLYSPATQPQFPLPPGAQQLSDRHGPEEQQDRQPACERDLQLHEGALPLLQDGPRRVEELGAAQPVSEQVLREGGEQDERLLPQGLPVGSEPGPHRQDGGGDAQVEEEGPGCHPPEYGQP

SEQ ID NO: 32603 - protein, 84 aa, Homo sapiens
  Payload ID: 6396
  Gene Symbol: FOXN4
  Gene Name: forkhead box N4
  ENSP ID: ENSP00000474754
  MOD_RES (1)..(1): Any amino acid
XKNSKTGSLPVSEIYSFMKEHFPYFKTAPDGWKNSVRHNLSLNKCFEKVDKQPSIPRPLDTPPRPEPQCLPVLSETSPSWILAA

SEQ ID NO: 32604 - protein, 655 aa, Homo sapiens
  Payload ID: 6397
  Gene Symbol: FOXO1
  Gene Name: forkhead box O1
  Uniprot ID: Q12778
  ENSP ID: ENSP00000368880
MAEAPQVVEIDPDFEPLPRPRSCTWPLPRPEFSQSNSATSSPAPSGSAAANPDAAAGLPSASAAAVSADFMSNLSLLEESEDFPQAPGSVAAAVAAAAAAAATGGLCGDFQGPEAGCLHPAPPQPPPPGPLSQHPPVPPAAAGPLAGQPRKSSSSRRNAWGNLSYADLITKAIESSAEKRLTLSQIYEWMVKSVPYFKDKGDSNSSAGWKNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQASHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 32605 - protein, 673 aa, Homo sapiens
  Payload ID: 6398
  Gene Symbol: FOXO3
  Gene Name: forkhead box O3
  Uniprot ID: O43524
  ENSP ID: ENSP00000339527
MAEAPASPAPLSPLEVELDPEFEPQSRPRSCTWPLQRPELQASPAKPSGETAADSMIPEEEDDEDDEDGGGRAGSAMAIGGGGGSGTLGSGLLLEDSARVLAPGGQDPGSGPATAAGGLSGGTQALLQPQQPLPPPQPGAAGGSGQPRKCSSRRNAWGNLSYADLITRAIESSPDKRLTLSQIYEWMVRCVPYFKDKGDSNSSAGWKNSIRHNLSLHSRFMRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 32606 - protein, 673 aa, Homo sapiens; identical to SEQ ID NO: 32605
  Payload ID: 6398
  Gene Symbol: FOXO3
  Gene Name: forkhead box O3
  Uniprot ID: O43524
  ENSP ID: ENSP00000385824

SEQ ID NO: 32607 - protein, 453 aa, Homo sapiens
  Payload ID: 6398
  Gene Symbol: FOXO3
  Gene Name: forkhead box O3
  Uniprot ID: O43524
  ENSP ID: ENSP00000446316
MRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 32608 - protein, 450 aa, Homo sapiens
  Payload ID: 6399
  Gene Symbol: FOXO4
  Gene Name: forkhead box O4
  Uniprot ID: P98177
  ENSP ID: ENSP00000342209
MDPGNENSATEAAAIIDLDPDFEPQSRPRSCTWPLPRPEIANQPSEPPEVEPDLGEKAIESAPEKRLTLAQIYEWMVRTVPYFKDKGDSNSSAGWKNSIRHNLSLHSKFIKVHNEATGKSSWWMLNPEGGKSGKAPRRRAASMDSSSKLLRGRSKAPKKKPSVLPAPPEGATPTSPVGHFAKWSGSPCSRNREEADMWTTFRPRSSSNASSVSTRLSPLRPESEVLAEEIPASVSSYAGGVPPTLNEGLELLDGLNLTSSHSLLSRSGLSGFSLQHPGVTGPLHTYSSSLFSPAEGPLSAGEGCFSSSQALEALLTSDTPPPPADVLMTQVDPILSQAPTLLLLGGLPSSSKLATGVGLCPKPLEAPGPSSLVPTLSMIAPPPVMASAPIPKALGTPVLTPPTEAASQDRMPQDLDLDMYMENLECDMDNIISDLMDEGEGLDFNFEPDP

SEQ ID NO: 32609 - protein, 505 aa, Homo sapiens
  Payload ID: 6399
  Gene Symbol: FOXO4
  Gene Name: forkhead box O4
  Uniprot ID: P98177
  ENSP ID: ENSP00000363377
MDPGNENSATEAAAIIDLDPDFEPQSRPRSCTWPLPRPEIANQPSEPPEVEPDLGEKVHTEGRSEPILLPSRLPEPAGGPQPGILGAVTGPRKGGSRRNAWGNQSYAELISQAIESAPEKRLTLAQIYEWMVRTVPYFKDKGDSNSSAGWKNSIRHNLSLHSKFIKVHNEATGKSSWWMLNPEGGKSGKAPRRRAASMDSSSKLLRGRSKAPKKKPSVLPAPPEGATPTSPVGHFAKWSGSPCSRNREEADMWTTFRPRSSSNASSVSTRLSPLRPESEVLAEEIPASVSSYAGGVPPTLNEGLELLDGLNLTSSHSLLSRSGLSGFSLQHPGVTGPLHTYSSSLFSPAEGPLSAGEGCFSSSQALEALLTSDTPPPPADVLMTQVDPILSQAPTLLLLGGLPSSSKLATGVGLCPKPLEAPGPSSLVPTLSMIAPPPVMASAPIPKALGTPVLTPPTEAASQDRMPQDLDLDMYMENLECDMDNIISDLMDEGEGLDFNFEPDP

SEQ ID NO: 32610 - protein, 559 aa, Homo sapiens
  Payload ID: 6400
  Gene Symbol: FOXO6
  Gene Name: forkhead box O6
  ENSP ID: ENSP00000361672
MAAKLRAHQVDVDPDFAPQSRPRSCTWPLPQPDLAGDEDGALGAGVAEGAEDCGPERRATAPAMAPAPPLGAEVGPLRKAKSSRRNAWGNLSYADLITKAIESAPDKRLTLSQIYDWMVRYVPYFKDKGDSNSSAGWKNSIRHNLSLHTRFIRVQNEGTGKSSWWMLNPEGGKTGKTPRRRAVSMDNGAKFLRIKGKASKKKQLQAPERSPDDSSPSAPAPGPVPAAAKWAASPASHASDDYEAWADFRGGGRPLLGEAAELEDDEALEALAPSSPLMYPSPASALSPALGSRCPGELPRLAELGGPLGLHGGGGAGLPEGLLDGAQDAYGPRARAQARPGAGCAGGAGAGGRSRRLPRQRGGPVRAARALAQCLSPPHQPYDAARRGGRRGPGTAGPRRRLRGPARRPPAGRSAGALRCRRRRAAGRRARPLPGRPGPRHVQREPRVRRGVHHPQRLHGQRRNGLQLRFGPASAAAGPGRGPAPQPELGAGLRAASRLRAPRPVPRGPLSSHPDSRVPAPDSSSPGGGPSPARDPSRRPAAGEGEGGAGAPHCSCPHS

SEQ ID NO: 32611 - protein, 492 aa, Homo sapiens
  Payload ID: 6400
  Gene Symbol: FOXO6
  Gene Name: forkhead box O6
  Uniprot ID: A8MYZ6
  ENSP ID: ENSP00000484727
MAAKLRAHQVDVDPDFAPQSRPRSCTWPLPQPDLAGDEDGALGAGVAEGAEDCGPERRATAPAMAPAPPLGAEVGPLRKAKSSRRNAWGNLSYADLITKAIESAPDKRLTLSQIYDWMVRYVPYFKDKGDSNSSAGWKNSIRHNLSLHTRFIRVQNEGTGKSSWWMLNPEGGKTGKTPRRRAVSMDNGAKFLRIKGKASKKKQLQAPERSPDDSSPSAPAPGPVPAAAKWAASPASHASDDYEAWADFRGGGRPLLGEAAELEDDEALEALAPSSPLMYPSPASALSPALGSRCPGELPRLAELGGPLGLHGGGGAGLPEGLLDGAQDAYGPRPAPRPGPVLGAPGELALAGAAAAYPGKGAAPYAPPAPSRSALAHPISLMTLPGEAGAAGLAPPGHAAAFGGPPGGLLLDALPGPYAAAAAGPLGAAPDRFPADLDLDMFSGSLECDVESIILNDFMDSDEMDFNFDSALPPPPPGLAGAPPPNQSWVPG

SEQ ID NO: 32612 - protein, 559 aa, Homo sapiens
  Payload ID: 6400
  Gene Symbol: FOXO6
  Gene Name: Forkhead box O6
  ENSP ID: ENSP00000486069
MAAKLRAHQVDVDPDFAPQSRPRSCTWPLPQPDLAGDEDGALGAGVAEGAEDCGPERRATAPAMAPAPPLGAEVGPLRKAKSSRRNAWGNLSYADLITKAIESAPDKRLTLSQIYDWMVRYVPYFKDKGDSNSSAGWKNSIRHNLSLHTRFIRVQNEGTGKSSWWMLNPEGGKTGKTPRRRAVSMDNGAKFLRIKGKASKKKQLQAPERSPDDSSPSAPAPGPVPAAAKWAASPASHASDDYEAWADFRGGGRPLLGEAAELEDDEALEALAPSSPLMYPSPASALSPALGSRCPGELPRLAELGGPLGLHGGGGAGLPEGLLDGAQDAYGPRARAGARPGAGCAGGAGAGGRSRRLPRQRGGPVRAARALAQCLSPPHQPYDAARRGGRRGPGTVGPRRRLRGPARRPPAGRSAGALRCRRRRAAGRRARPLPGRPGPRHVQREPRVRRGVHHPQRLHGQRRNGLQLRFGPASTAAGPGRGPAPQPELGAGLRAASRLRAPRPVPRGPLSSHPDSRVPAPDSSSPGGGPSPARDPSRRPAAGEGEGGAGAPHCSCPHS

SEQ ID NO: 32613 - protein, 559 aa, Homo sapiens
  Payload ID: 6400
  Gene Symbol: FOXO6
  Gene Name: Forkhead box O6
  ENSP ID: ENSP00000487155
MAAKLRAHQVDVDPDFAPQSRPRSCTWPLPQPDLAGDEDGALGAGVAEGAEDCGPERRATAPAMAPAPPLGAEVGPLRKAKSSRRNAWGNLSYADLITKAIESAPDKRLTLSQIYDWMVRYVPYFKDKGDSNSSAGWKNSIRHNLSLHTRFIRVQNEGTGKSSWWMLNPEGGKTGKTPRRRAVSMDNGAKFLRIKGKASKKKQLQAPERSPDDSSPSAPAPGPVPAAAKWAASPASHASDDYEAWADFRGGGRPLLGEAAELEDDEALEALAPSSPLMYPSPASALSPALGSRCPGELPRLAELGGPLGLHGGGGAGLPEGLLDGAQDAYGPRARAGTPAYFGGCKGGAYGGGGGFGPPAMGALRRLPMQTIQENKQASFVPAAAPFRPGALPALLPPPPPAPRPGPVLGAPGELALAGAAAAYPGKGAAPYAPPAPSRSALAHPISLMTLPGEAGAAGLAPSGHAAAFGGPPGGLLLDALPGPYAAAAAGPLGAAPDRFPADLDLDMFSGSLECDVESIILNDFMDSDEMDFNFDSALPPPPPGLAGAPPPNQSWVPG

SEQ ID NO: 32614 - protein, 114 aa, Homo sapiens
  Payload ID: 6401
  Gene Symbol: FOXP1
  Gene Name: forkhead box P1
  Uniprot ID: Q9H334
  ENSP ID: ENSP00000318721
MMQESGTETKSNGSAIQNGSGGSNHLLECGGLREGRSNGETPAVDIGAADLAHAQQQQQQWHLINHQPSRSPSSWLKRLISSPWELEVLQVPLWGAVAETKMSGPVCQPNPSPF

SEQ ID NO: 32615 - protein, 677 aa, Homo sapiens
  Payload ID: 6401
  Gene Symbol: FOXP1
  Gene Name: forkhead box P1
  Uniprot ID: Q9H334
  ENSP ID: ENSP00000318902
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 32616 - protein, 566 aa, Homo sapiens
  Payload ID: 6401
  Gene Symbol: FOXP1
  Gene Name: forkhead box P1
  ENSP ID: ENSP00000333560
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGVPFAPTSHCISALSE

SEQ ID NO: 32617 - protein, 601 aa, Homo sapiens
  Payload ID: 6401
  Gene Symbol: FOXP1
  Gene Name: forkhead box P1
  Uniprot ID: Q9H334
  ENSP ID: ENSP00000417857
MMQESGTETKSNGSAIQNGSGGSNHLLECGGLREGRSNGETPAVDIGAADLAHAQQQQQQALQVARQLLLQQQQQQQVSGLKSPKRNDKQPALQQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 32618 - protein, 224 aa, Homo sapiens
  Payload ID: 6401
  Gene Symbol: FOXP1
  Gene Name: forkhead box P1
  ENSP ID: ENSP00000417941
MMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFL

SEQ ID NO: 32619 - protein, 677 aa, Homo sapiens; identical to SEQ ID NO: 32615
  Payload ID: 6401
  Gene Symbol: FOXP1
  Gene Name: forkhead box P1
  Uniprot ID: Q9H334
  ENSP ID: ENSP00000418102

SEQ ID NO: 32620 - protein, 573 aa, Homo sapiens
  Payload ID: 6401
  Gene Symbol: FOXP1
  Gene Name: forkhead box P1
  ENSP ID: ENSP00000418225
ASQKQPEPIYSKKTEIQRQTVRAPFAKLFIFSALQVARQLLLQQQQQQQVSGLKSPKRNDKQPALQQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 32621 - protein, 676 aa, Homo sapiens
  Payload ID: 6401
  Gene Symbol: FOXP1
  Gene Name: forkhead box P1
  Uniprot ID: Q9H334
  ENSP ID: ENSP00000418524
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSDIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 32622 - protein, 123 aa, Homo sapiens
  Payload ID: 6401
  Gene Symbol: FOXP1
  Gene Name: forkhead box P1
  ENSP ID: ENSP00000418784
MMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGM

SEQ ID NO: 32623 - protein, 613 aa, Homo sapiens
  Payload ID: 6401
  Gene Symbol: FOXP1
  Gene Name: forkhead box P1
  ENSP ID: ENSP00000418883
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 32624 - protein, 677 aa, Homo sapiens; identical to SEQ ID NO: 32615
  Payload ID: 6401
  Gene Symbol: FOXP1
  Gene Name: forkhead box P1
  Uniprot ID: Q9H334
  ENSP ID: ENSP00000419393

SEQ ID NO: 32625 - protein, 679 aa, Homo sapiens
  Payload ID: 6401
  Gene Symbol: FOXP1
  Gene Name: forkhead box P1
  ENSP ID: ENSP00000420736
MFQCVFSSSVLQPHSTSCLFKHLFYHSATPASQKQPEPIYSKKTEIQRQTVRAPFAKLFIFSALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 32626 - protein, 114 aa, Homo sapiens; identical to SEQ ID NO: 32614
  Payload ID: 6401
  Gene Symbol: FOXP1
  Gene Name: forkhead box P1
  Uniprot ID: Q9H334
  ENSP ID: ENSP00000477918

SEQ ID NO: 32627 - protein, 117 aa, Homo sapiens
  Payload ID: 6401
  Gene Symbol: FOXP1
  Gene Name: forkhead box P1
  ENSP ID: ENSP00000479663
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQ

SEQ ID NO: 32628 - protein, 577 aa, Homo sapiens
  Payload ID: 6401
  Gene Symbol: FOXP1
  Gene Name: forkhead box P1
  ENSP ID: ENSP00000482847
MMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 32629 - protein, 693 aa, Homo sapiens
  Payload ID: 6401
  Gene Symbol: FOXP1
  Gene Name: forkhead box P1
  ENSP ID: ENSP00000484803
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKGAIRTNLSLHKCFIRVEDEFGSFWTVDDEEFKRGRHIQRGRPRKYCPDENFDELVAHNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 32630 - protein, 203 aa, Homo sapiens
  Payload ID: 6401
  Gene Symbol: FOXP1
  Gene Name: forkhead box P1
  ENSP ID: ENSP00000484963
VPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRERQSFHTQR

SEQ ID NO: 32631 - protein, 715 aa, Homo sapiens
  Payload ID: 6402
  Gene Symbol: FOXP2
  Gene Name: forkhead box P2
  Uniprot ID: O15409
  ENSP ID: ENSP00000265436
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 32632 - protein, 432 aa, Homo sapiens
  Payload ID: 6402
  Gene Symbol: FOXP2
  Gene Name: forkhead box P2
  Uniprot ID: O15409
  ENSP ID: ENSP00000353367
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPVSAYCFINSK

SEQ ID NO: 32633 - protein, 365 aa, Homo sapiens
  Payload ID: 6402
  Gene Symbol: FOXP2
  Gene Name: forkhead box P2
  Uniprot ID: O15409
  ENSP ID: ENSP00000367482
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLK

SEQ ID NO: 32634 - protein, 456 aa, Homo sapiens
  Payload ID: 6402
  Gene Symbol: FOXP2
  Gene Name: forkhead box P2
  ENSP ID: ENSP00000375084
MQESATETISNSSMNQNGMSTLSSQLDAGSRDGRSSGDTSSEVSTVELLHLQQQQALQAARQLLLQQQTSGLKSPKSSDKQRPLQELLPETKLCICGHSSGDGHPHNTFAVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPVSAYCFINSK

SEQ ID NO: 32635 - protein, 623 aa, Homo sapiens
  Payload ID: 6402
  Gene Symbol: FOXP2
  Gene Name: forkhead box P2
  Uniprot ID: O15409
  ENSP ID: ENSP00000377129
MMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 32636 - protein, 530 aa, Homo sapiens
  Payload ID: 6402
  Gene Symbol: FOXP2
  Gene Name: forkhead box P2
  ENSP ID: ENSP00000377130
MMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 32637 - protein, 715 aa, Homo sapiens; identical to SEQ ID NO: 32631
  Payload ID: 6402
  Gene Symbol: FOXP2
  Gene Name: forkhead box P2
  Uniprot ID: O15409
  ENSP ID: ENSP00000377132

SEQ ID NO: 32638 - protein, 171 aa, Homo sapiens
  Payload ID: 6402
  Gene Symbol: FOXP2
  Gene Name: forkhead box P2
  ENSP ID: ENSP00000377133
MMQESATETISNSSMNQNGMSTLSSQLDAGSRDGRSSGDTSSEVSTVELLHLQQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIV

SEQ ID NO: 32639 - protein, 694 aa, Homo sapiens
  Payload ID: 6402
  Gene Symbol: FOXP2
  Gene Name: forkhead box P2
  ENSP ID: ENSP00000377135
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQQQQQQQQQQQQQQQQQQQQQQQQQQQQQQQQQQQQQQHPGKQAKEQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 32640 - protein, 732 aa, Homo sapiens
  Payload ID: 6402
  Gene Symbol: FOXP2
  Gene Name: forkhead box P2
  Uniprot ID: O15409
  ENSP ID: ENSP00000385069
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQDFLDSGLENFRAALEKNQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 32641 - protein, 740 aa, Homo sapiens
  Payload ID: 6402
  Gene Symbol: FOXP2
  Gene Name: forkhead box P2
  Uniprot ID: O15409
  ENSP ID: ENSP00000386200
MMQESATETISNSSMNQNGMSTLSSQLDAGSRDGRSSGDTSSEVSTVELLHLQQQQALQAARQLLLQQQTSGLKSPKSSDKQRPLQELLPETKLCICGHSSGDGHPHNTFAVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 32642 - protein, 82 aa, Homo sapiens
  Payload ID: 6402
  Gene Symbol: FOXP2
  Gene Name: forkhead box P2
  ENSP ID: ENSP00000395552
MMQESATETISNSSMNQNGMSTLSSQLDAGSRDGRSSGDTSSEVSTVELLHLQQQQAGVQWCNHNSLQPGTPGLKQSSDLSL

SEQ ID NO: 32643 - protein, 87 aa, Homo sapiens
  Payload ID: 6402
  Gene Symbol: FOXP2
  Gene Name: forkhead box P2
  Uniprot ID: O15409
  ENSP ID: ENSP00000405470
MMQESATETISNSSMNQNGMSTLSSQLDAGSRDGRSSGDTSSEVSTVELLHLQQQQALQAARQLLLQQQTSGLKSPKSSDKQRPLQP

SEQ ID NO: 32644 - protein, 205 aa, Homo sapiens
  Payload ID: 6402
  Gene Symbol: FOXP2
  Gene Name: forkhead box P2
  ENSP ID: ENSP00000409826
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQSKWFIQQQLQEFYKKQQEQLHLQLLQQQQQQQQQQQQQQQQQQQQQQQQQQQQQQQQQQQQQQQQHPGKQAKE

SEQ ID NO: 32645 - protein, 87 aa, Homo sapiens; identical to SEQ ID NO: 32643
  Payload ID: 6402
  Gene Symbol: FOXP2
  Gene Name: forkhead box P2
  Uniprot ID: O15409
  ENSP ID: ENSP00000416825

SEQ ID NO: 32646 - protein, 67 aa, Homo sapiens
  Payload ID: 6402
  Gene Symbol: FOXP2
  Gene Name: forkhead box P2
  ENSP ID: ENSP00000418100
MMQESATETISNSSMNQNGMSTLSSQLDAGSRDGRSSGDTSSEVSTVELLHLQQQQEDVVSYTQVIC

SEQ ID NO: 32647 - protein, 589 aa, Homo sapiens
  Payload ID: 6402
  Gene Symbol: FOXP2
  Gene Name: forkhead box P2
  ENSP ID: ENSP00000488944
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQQQQQQQQQQQQQQQQQQQQQQQQQQQQQQQQQQQQQHPGKQAKEQQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALN

SEQ ID NO: 32648 - protein, 228 aa, Homo sapiens
  Payload ID: 6402
  Gene Symbol: FOXP2
  Gene Name: forkhead box P2
  ENSP ID: ENSP00000488954
  MOD_RES (1)..(1): Any amino acid
XLLQQQQQQQQQQQQQQQQQQQQQQQQQQQQQQQQQQQQQQQQHPGKQAKEQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQC

SEQ ID NO: 32649 - protein, 716 aa, Homo sapiens
  Payload ID: 6402
  Gene Symbol: FOXP2
  Gene Name: forkhead box P2
  ENSP ID: ENSP00000489073
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 32650 - protein, 698 aa, Homo sapiens
  Payload ID: 6402
  Gene Symbol: FOXP2
  Gene Name: forkhead box P2
  ENSP ID: ENSP00000489135
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 32651 - protein, 712 aa, Homo sapiens
  Payload ID: 6402
  Gene Symbol: FOXP2
  Gene Name: forkhead box P2
  ENSP ID: ENSP00000489229
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQDFLDSGLENFRAALEKNQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 32652 - protein, 87 aa, Homo sapiens; identical to SEQ ID NO: 32643
  Payload ID: 6402
  Gene Symbol: FOXP2
  Gene Name: forkhead box P2
  ENSP ID: ENSP00000489457

SEQ ID NO: 32653 - protein, 441 aa, Homo sapiens
  Payload ID: 6403
  Gene Symbol: FOXP3
  Gene Name: forkhead box P3
  ENSP ID: ENSP00000365369
MSPISGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKVSSSEVAVTGMASSAIAAQSGQAWVWAHRHIGEERDVGCWWWLLASEVDAHLLPVPGLPQNAIRHNLSLHKCFVRVESEKGAVWTVDELEFRKKRSQRPSRCSNPTPGP

SEQ ID NO: 32654 - protein, 396 aa, Homo sapiens
  Payload ID: 6403
  Gene Symbol: FOXP3
  Gene Name: forkhead box P3
  Uniprot ID: Q9BZS1
  ENSP ID: ENSP00000365372
MPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 32655 - protein, 431 aa, Homo sapiens
  Payload ID: 6403
  Gene Symbol: FOXP3
  Gene Name: forkhead box P3
  Uniprot ID: Q9BZS1
  ENSP ID: ENSP00000365380
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 32656 - protein, 454 aa, Homo sapiens
  Payload ID: 6403
  Gene Symbol: FOXP3
  Gene Name: forkhead box P3
  ENSP ID: ENSP00000396415
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDRSVDRAGKDPRPPIPSPDTLCPPSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 32657 - protein, 396 aa, Homo sapiens; identical to SEQ ID NO: 32654
  Payload ID: 6403
  Gene Symbol: FOXP3
  Gene Name: forkhead box P3
  Uniprot ID: Q9BZS1
  ENSP ID: ENSP00000428952

SEQ ID NO: 32658 - protein, 456 aa, Homo sapiens
  Payload ID: 6403
  Gene Symbol: FOXP3
  Gene Name: forkhead box P3
  Uniprot ID: Q9BZS1
  ENSP ID: ENSP00000451208
MPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKVSSSEVAVTGMASSAIAAQSGQAWVWAHRHIGEERDVGCWWWLLASEVDAHLLPVPGLPQNAIRHNLSLHKCFVRVESEKGAVWTVDELEFRKKRSQRPSRCSNPTPGP

SEQ ID NO: 32659 - protein, 680 aa, Homo sapiens
  Payload ID: 6404
  Gene Symbol: FOXP4
  Gene Name: forkhead box P4
  Uniprot ID: Q8IVH2
  ENSP ID: ENSP00000309823
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 32660 - protein, 678 aa, Homo sapiens
  Payload ID: 6404
  Gene Symbol: FOXP4
  Gene Name: forkhead box P4
  Uniprot ID: Q8IVH2
  ENSP ID: ENSP00000362148
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 32661 - protein, 680 aa, Homo sapiens; identical to SEQ ID NO: 32659
  Payload ID: 6404
  Gene Symbol: FOXP4
  Gene Name: forkhead box P4
  Uniprot ID: Q8IVH2
  ENSP ID: ENSP00000362151

SEQ ID NO: 32662 - protein, 667 aa, Homo sapiens
  Payload ID: 6404
  Gene Symbol: FOXP4
  Gene Name: forkhead box P4
  Uniprot ID: Q8IVH2
  ENSP ID: ENSP00000362154
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 32663 - protein, 668 aa, Homo sapiens
  Payload ID: 6404
  Gene Symbol: FOXP4
  Gene Name: forkhead box P4
  ENSP ID: ENSP00000386958
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 32664 - protein, 87 aa, Homo sapiens
  Payload ID: 6404
  Gene Symbol: FOXP4
  Gene Name: forkhead box P4
  ENSP ID: ENSP00000393704
MEGELGPALSRGEAYGHHTSSYQLLGNAQKLPFPPWPDTALQVARQFLLQQASGLSSPGNNDSKQSASAVQVPVSVAMMSPQMLTPQ

SEQ ID NO: 32665 - protein, 403 aa, Homo sapiens
  Payload ID: 6405
  Gene Symbol: FOXQ1
  Gene Name: forkhead box Q1
  Uniprot ID: Q9C009
  ENSP ID: ENSP00000296839
MKLEVFVPRAAHGDKQGSDLEGAGGSDAPSPLSAAGDDSLGSDGDCAANSPAAGGGARDTQGDGEQSAGGGPGAEEAIPAAAAAAVVAEGAEAGAAGPGAGGAGSGEGARSKPYTRRPKPPYSYIALIAMAIRDSAGGRLTLAEINEYLMGKFPFFRGSYTGWRNSVRHNLSLNDCFVKVLRDPSRPWGKDNYWMLNPNSEYTFADGVFRRRRKRLSHRAPVPAPGLRPEEAPGLPAAPPPAPAAPASPRMRSPARQEERASPAGKFSSSFAIDSILRKPFRSRRLRDTAPGTTLQWGAAPCPPLPAFPALLPAAPCRALLPLCAYGAGEPARLGAREAEVPPTAPPLLLAPLPAAAPAKPLRGPAAGGAHLYCPLRLPAALQAASVRRPGPHLPYPVETLLA

SEQ ID NO: 32666 - protein, 292 aa, Homo sapiens
  Payload ID: 6406
  Gene Symbol: FOXR1
  Gene Name: forkhead box R1
  Uniprot ID: Q6PIV2
  ENSP ID: ENSP00000314806
MGNELFLAFTTSHLPLAEQKLARYKLRIVKPPKLPLEKKPNPDKDGPDYEPNLWMWVNPNIVYPPGKLEVSGRRKREDLTSTLPSSQPPQKEEDASCSEAAGVESLSQSSSKRSPPRKRFAFSPSTWELTEEEEAEDQEDSSSMALPSPHKRAPLQSRRLRQASSQAGRLWSRPPLNYFHLIALALRNSSPCGLNVQQIYSFTRKHFPFFRTAPEGWKNTVRHNLCFRDSFEKVPVSMQGGASTRPRSCLWKLTEEGHRRFAEEARALASTRLESIQQCMSQPDVMPFLFDL

SEQ ID NO: 32667 - protein, 136 aa, Homo sapiens
  Payload ID: 6406
  Gene Symbol: FOXR1
  Gene Name: forkhead box R1
  ENSP ID: ENSP00000432358
  MOD_RES (1)..(1): Any amino acid
XVARYKLRIVKPPKLPLEKKPNPDKDGPDYEPNLWMWVNPNIVYPPGKLEVSGRRKREDLTSTLPSSQPPQKEEDASCSEAAGVESLSQSSSKRSPPRKRFAFSPSTWEKALPLFPDGPGRLEEYCPSQSLFSRQL

SEQ ID NO: 32668 - protein, 206 aa, Homo sapiens
  Payload ID: 6406
  Gene Symbol: FOXR1
  Gene Name: forkhead box R1
  Uniprot ID: Q6PIV2
  ENSP ID: ENSP00000433394
MGNELFLAFTTSHLPLAEQKLARYKLRIVKPPKLPLEKKPNPDKDGPDYEPNLWMWVNPNIVYPPGKLEVSGRRKREDLTSTLPSSQPPQKEEDASCSEAAGVESLSQSSSKRSPPRKRFAFSPSTWEGPPPESEASASQQPGGEALVPAPSQLLPPNCPGIKKQFPLWPQRATDLQFHSELLGLILLCSCCGPSPGPSEGGRVQL

SEQ ID NO: 32669 - protein, 292 aa, Homo sapiens; identical to SEQ ID NO: 32666
  Payload ID: 6406
  Gene Symbol: FOXR1
  Gene Name: forkhead box R1
  ENSP ID: ENSP00000487495

SEQ ID NO: 32670 - protein, 136 aa, Homo sapiens; identical to SEQ ID NO: 32667
  Payload ID: 6406
  Gene Symbol: FOXR1
  Gene Name: forkhead box R1
  ENSP ID: ENSP00000489131
  MOD_RES (1)..(1): Any amino acid

SEQ ID NO: 32671 - protein, 206 aa, Homo sapiens; identical to SEQ ID NO: 32668
  Payload ID: 6406
  Gene Symbol: FOXR1
  Gene Name: forkhead box R1
  ENSP ID: ENSP00000489241

SEQ ID NO: 32672 - protein, 311 aa, Homo sapiens
  Payload ID: 6407
  Gene Symbol: FOXR2
  Gene Name: forkhead box R2
  Uniprot ID: Q6PJQ5
  ENSP ID: ENSP00000427329
MDLKLKDCEFWYSLHGQVPGLLDWDMRNELFLPCTTDQCSLAEQILAKYRVGVMKPPEMPQKRRPSPDGDGPPCEPNLWMWVDPNILCPLGSQEAPKPSGKEDLTNISPFPQPPQKDEGSNCSEDKVVESLPSSSSEQSPLQKQGIHSPSDFELTEEEAEEPDDNSLQSPEMKCYQSQKLWQINNQEKSWQRPPLNCSHLIALALRNNPHCGLSVQEIYNFTRQHFPFFWTAPDGWKSTIHYNLCFLDSFEKVPDSLKDEDNARPRSCLWKLTKEGHRRFWEETRVLAFAQRERIQECMSQPELLTSLFDL

SEQ ID NO: 32673 - protein, 330 aa, Homo sapiens
  Payload ID: 6408
  Gene Symbol: FOXS1
  Gene Name: forkhead box S1
  Uniprot ID: O43638
  ENSP ID: ENSP00000365145
MQQQPLPGPGAPTTEPTKPPYSYIALIAMAIQSSPGQRATLSGIYRYIMGRFAFYRHNRPGWQNSIRHNLSLNECFVKVPRDDRKPGKGSYWTLDPDCHDMFEHGSFLRRRRRFTRQTGAEGTRGPAKARRGPLRATSQDPGVPNATTGRQCSFPPELPDPKGLSFGGLVGAMPASMCPATTDGRPRPPMEPKEISTPKPACPGELPVATSSSSCPAFGFPAGFSEAESFNKAPTPVLSPESGIGSSYQCRLQALNFCMGADPGLEHLLASAAPSPAPPTPPGSLRAPLPLPTDHKEPWVAGGFPVQGGSGYPLGLTPCLYRTPGMFFFE

SEQ ID NO: 32674 - protein, 647 aa, Homo sapiens
  Payload ID: 6409
  Gene Symbol: FHAD1
  Gene Name: forkhead-associated (FHA) phosphopeptide binding domain 1
  ENSP ID: ENSP00000318812
ITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKVGTRKASLKMDQEREMLRKETSSKSSQSLLHSKPSGKY

SEQ ID NO: 32675 - protein, 1412 aa, Homo sapiens
  Payload ID: 6409
  Gene Symbol: FHAD1
  Gene Name: forkhead-associated (FHA) phosphopeptide binding domain 1
  Uniprot ID: B1AJZ9
  ENSP ID: ENSP00000351770
MKAYLKSAEGFFVLNKSTTIGRHENSDLVLQSPDIDNHHALIEYNEAECSFVLQDFNSRNGTFVNECHIQNVAVKLIPGDILRFGSAGLTYELVIENPPPVSFPWMRGPAPWPGPQPPRATQQPNQAPPPSHIPFHQGVQPAPMQRSWSQAFPRPTVVLPASHRRPVSANKEMFSFVVDDARKPPVIKQVWTNAMKLSEKSVAEGIPGAVPPAEIYVEEDLAQQDKDEIILLLGKEVSRLSDYEIESKYKDVIIANLQNEVAELSQKVSETTTSRQNEKEISQKCQVLDEDIDAKQKEIQSLKSQISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKDQVQQFSGNSAVFTAGKAAGASGREGEAERGEARARGEAQSQNQATDGREGGKALEEYITQERNRAKETLEEERKRMQELESLLAQQKKALAKSITQEKNRVKEALEEEQTRVQELEERLARQKEVLESSIAHEKRKAKEALESEKRKVQDLENHLTQQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKVGTRKASLKMDQEREMLRKETSSKSSQSLLHSKPSGKY

SEQ ID NO: 32676 - protein, 251 aa, Homo sapiens
  Payload ID: 6409
  Gene Symbol: FHAD1
  Gene Name: forkhead-associated (FHA) phosphopeptide binding domain 1
  ENSP ID: ENSP00000365163
MILRPPRPCGTISALQKGYSKVLCQTLSERNSEITSLKNEGENLKRDNAITSGMVSSLQKDILAKDEQVQQLKEEVSHLKSQNKDKDHQLEALGSRLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGYWDFFSHMVA

SEQ ID NO: 32677 - protein, 316 aa, Homo sapiens
  Payload ID: 6409
  Gene Symbol: FHAD1
  Gene Name: forkhead-associated (FHA) phosphopeptide binding domain 1
  ENSP ID: ENSP00000365165
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGYWDFFSHMVA

SEQ ID NO: 32678 - protein, 1412 aa, Homo sapiens; identical to SEQ ID NO: 32675
  Payload ID: 6409
  Gene Symbol: FHAD1
  Gene Name: forkhead-associated (FHA) phosphopeptide binding domain 1
  Uniprot ID: B1AJZ9
  ENSP ID: ENSP00000365166

SEQ ID NO: 32679 - protein, 693 aa, Homo sapiens
  Payload ID: 6409
  Gene Symbol: FHAD1
  Gene Name: forkhead-associated (FHA) phosphopeptide binding domain 1
  ENSP ID: ENSP00000399819
  MOD_RES (1)..(1): Any amino acid
XQQSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQK

SEQ ID NO: 32680 - protein, 190 aa, Homo sapiens
  Payload ID: 6409
  Gene Symbol: FHAD1
  Gene Name: forkhead-associated (FHA) phosphopeptide binding domain 1
  ENSP ID: ENSP00000402241
  MOD_RES (1)..(1): Any amino acid
XLETPRERGREASPRSWPDASRAGRALGGGRSVGFLLPPGKTERMKAYLKSAEGFFVLNKSTTIGRHENSDLVLQVSFPWMRGPAPWPGPQPPRATQQPNQAPPPSHIPFHQGVQPAPMQRSWSQAFPRPTVVLPASHRRPVSANKEMFSFVVDDARKPPVIKQVWTNAMKLSEKSVAEGIPGAVPPAEI

SEQ ID NO: 32681 - protein, 470 aa, Homo sapiens
  Payload ID: 6409
  Gene Symbol: FHAD1
  Gene Name: forkhead-associated (FHA) phosphopeptide binding domain 1
  ENSP ID: ENSP00000432147
  MOD_RES (1)..(1): Any amino acid
XAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKMRKLRLRELRGAQVHTAAGKDSWDLTPDPSDPGSPAVCRVGRKCRGARTEKRKRIDTLQLCLQRERQAGPAPPACSLNG

SEQ ID NO: 32682 - protein, 701 aa, Homo sapiens
  Payload ID: 6409
  Gene Symbol: FHAD1
  Gene Name: forkhead-associated (FHA) phosphopeptide binding domain 1
  ENSP ID: ENSP00000434909
ITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKRRVFVEMVKNRMQNSNSQVGTRKASLKMDQEREMLRKETSSKSSQSLLHSKPSGKY

SEQ ID NO: 32683 - protein, 120 aa, Homo sapiens
  Payload ID: 6409
  Gene Symbol: FHAD1
  Gene Name: forkhead-associated (FHA) phosphopeptide binding domain 1
  ENSP ID: ENSP00000436559
MILRPPRPCGTCSVLKEELKQEDAHRELREAQEKELKLCKTLEHFRSQVIKATYGRAKPFRDKPVTDQQLIEKITQVTEDNINFQQKKWTLQKETQLSNSKQEETTENIEKLRTSLDSCQ

SEQ ID NO: 32684 - protein, 541 aa, Homo sapiens
  Payload ID: 6410
  Gene Symbol: FTCD
  Gene Name: formimidoyltransferase cyclodeaminase
  Uniprot ID: O95954
  ENSP ID: ENSP00000291670
MSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 32685 - protein, 495 aa, Homo sapiens
  Payload ID: 6410
  Gene Symbol: FTCD
  Gene Name: formimidoyltransferase cyclodeaminase
  ENSP ID: ENSP00000380851
MSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLAHGGPTGGSEAGSLCAADAGGDGGLAVAGPAGTGPVWEPGLPVRPPGGGQSPGDGRVWRIFQRAHQPEGHHRRGI

SEQ ID NO: 32686 - protein, 541 aa, Homo sapiens; identical to SEQ ID NO: 32684
  Payload ID: 6410
  Gene Symbol: FTCD
  Gene Name: formimidoyltransferase cyclodeaminase
  Uniprot ID: O95954
  ENSP ID: ENSP00000380854

SEQ ID NO: 32687 - protein, 572 aa, Homo sapiens
  Payload ID: 6410
  Gene Symbol: FTCD
  Gene Name: formimidoyltransferase cyclodeaminase
  Uniprot ID: O95954
  ENSP ID: ENSP00000380856
MSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQPPAGSQDPGCTGAGLLGDPAGVTVREASPGSVAPPSPIPRGQSCDLETPGTAGPSTLEG

SEQ ID NO: 32688 - protein, 133 aa, Homo sapiens
  Payload ID: 6410
  Gene Symbol: FTCD
  Gene Name: formimidoyltransferase cyclodeaminase
  ENSP ID: ENSP00000409015
  MOD_RES (1)..(1): Any amino acid
XLWPALQELARCGNLACRSDLQVAAKALEMGVFGAYFNVLINLRDITDEAFKDQPPAGSQDPGCTGAGLLGDPAGVTVREASPGSVAPPSPIPRGQSCDLGGDTACSCGARRVGGQAAGHRLGMEALAGTEGP

SEQ ID NO: 32689 - protein, 420 aa, Homo sapiens
  Payload ID: 6410
  Gene Symbol: FTCD
  Gene Name: formimidoyltransferase cyclodeaminase
  ENSP ID: ENSP00000485804
MSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYL

SEQ ID NO: 32690 - protein, 420 aa, Homo sapiens; identical to SEQ ID NO: 32689
  Payload ID: 6410
  Gene Symbol: FTCD
  Gene Name: formimidoyltransferase cyclodeaminase
  ENSP ID: ENSP00000486740

SEQ ID NO: 32691 - protein, 420 aa, Homo sapiens; identical to SEQ ID NO: 32689
  Payload ID: 6410
  Gene Symbol: FTCD
  Gene Name: formimidoyltransferase cyclodeaminase
  ENSP ID: ENSP00000487110

SEQ ID NO: 32692 - protein, 420 aa, Homo sapiens; identical to SEQ ID NO: 32689
  Payload ID: 6410
  Gene Symbol: FTCD
  Gene Name: formimidoyltransferase cyclodeaminase
  ENSP ID: ENSP00000487475

SEQ ID NO: 32693 - protein, 77 aa, Homo sapiens
  Payload ID: 6411
  Gene Symbol: FTCDNL1
  Gene Name: formiminotransferase cyclodeaminase N-terminal like
  ENSP ID: ENSP00000454447
MSSSRVGLRLAACLLNVSEAGRKYIVENIAKAALLDKNGKKHPQVSVLNIFSDQDYKRSVITIATSVDKLVDKRNQA

SEQ ID NO: 32694 - protein, 114 aa, Homo sapiens
  Payload ID: 6411
  Gene Symbol: FTCDNL1
  Gene Name: formiminotransferase cyclodeaminase N-terminal like
  ENSP ID: ENSP00000456442
MSSSRVGLRLAACLLNVSEAGRKYIVENIAKAALLDKNGKKHPQVSVLNIFSDQDYKRSVITIATSVDKLGSSVLAACLEAFQAIDMEVQEGIHPCLGAVDLIPIYPLSGVTVE

SEQ ID NO: 32695 - protein, 138 aa, Homo sapiens
  Payload ID: 6411
  Gene Symbol: FTCDNL1
  Gene Name: formiminotransferase cyclodeaminase N-terminal like
  ENSP ID: ENSP00000457780
MSSSRVGLRLAACLLNVSEAGRKYIVENIAKAALLDKNGKKHPQVSVLNIFSDQDYKRSVITIATSVDKLGLAEDLVLHVPGCSVFLFGEADLPEKRSLVQRRKQLGWFTRRDFSALQPDLGAAPSQRCGLTACFRAL

SEQ ID NO: 32696 - protein, 147 aa, Homo sapiens
  Payload ID: 6411
  Gene Symbol: FTCDNL1
  Gene Name: formiminotransferase cyclodeaminase N-terminal like
  Uniprot ID: E5RQL4
  ENSP ID: ENSP00000482786
MSSSRVGLRLAACLLNVSEAGRKYIVENIAKAALLDKNGKKHPQVSVLNIFSDQDYKRSVITIATSVDKLGLAEDLVLHVPGCSVFLFGEADLPEKRSLVQRRKQLGWFTRRDFSALQPDLGAAPSQRCGLTGSEHGFCFALFFFFF

SEQ ID NO: 32697 - protein, 662 aa, Homo sapiens; identical to SEQ ID NO: 32401
  Payload ID: 6412
  Gene Symbol: FMN1
  Gene Name: formin 1
  Uniprot ID: Q68DA7
  ENSP ID: ENSP00000325166

SEQ ID NO: 32698 - protein, 1196 aa, Homo sapiens; identical to SEQ ID NO: 32403
  Payload ID: 6412
  Gene Symbol: FMN1
  Gene Name: formin 1
  Uniprot ID: Q68DA7
  ENSP ID: ENSP00000333950

SEQ ID NO: 32699 - protein, 503 aa, Homo sapiens; identical to SEQ ID NO: 32409
  Payload ID: 6412
  Gene Symbol: FMN1
  Gene Name: formin 1
  Uniprot ID: Q68DA7
  ENSP ID: ENSP00000452984

SEQ ID NO: 32700 - protein, 114 aa, Homo sapiens; identical to SEQ ID NO: 32408
  Payload ID: 6412
  Gene Symbol: FMN1
  Gene Name: formin 1
  ENSP ID: ENSP00000453110
  MOD_RES (1)..(1): Any amino acid

SEQ ID NO: 32701 - protein, 181 aa, Homo sapiens; identical to SEQ ID NO: 32407
  Payload ID: 6412
  Gene Symbol: FMN1
  Gene Name: formin 1
  ENSP ID: ENSP00000453266
  MOD_RES (1)..(1): Any amino acid

SEQ ID NO: 32702 - protein, 1321 aa, Homo sapiens; identical to SEQ ID NO: 32402
  Payload ID: 6412
  Gene Symbol: FMN1
  Gene Name: formin 1
  ENSP ID: ENSP00000453443

SEQ ID NO: 32703 - protein, 58 aa, Homo sapiens; identical to SEQ ID NO: 32405
  Payload ID: 6412
  Gene Symbol: FMN1
  Gene Name: formin 1
  ENSP ID: ENSP00000453682
  MOD_RES (1)..(1): Any amino acid

SEQ ID NO: 32704 - protein, 1419 aa, Homo sapiens; identical to SEQ ID NO: 32404
  Payload ID: 6412
  Gene Symbol: FMN1
  Gene Name: formin 1
  Uniprot ID: Q68DA7
  ENSP ID: ENSP00000454047

SEQ ID NO: 32705 - protein, 1419 aa, Homo sapiens; identical to SEQ ID NO: 32404
  Payload ID: 6412
  Gene Symbol: FMN1
  Gene Name: formin 1
  Uniprot ID: Q68DA7
  ENSP ID: ENSP00000479134

SEQ ID NO: 32706 - protein, 1722 aa, Homo sapiens
  Payload ID: 6413
  Gene Symbol: FMN2
  Gene Name: formin 2
  Uniprot ID: Q9NZ56
  ENSP ID: ENSP00000318884
MGNQDGKLKRSAGDALHEGGGGAEDALGPRDVEATKKGSGGKKALGKHGKGGGGGGGGGESGKKKSKSDSRASVFSNLRIRKNLSKGKGAGGSREDVLDSQALQTGELDSAHSLLTKTPDLSLSADEAGLSDTECADPFEVTGPGGPGPAEARVGGRPIAEDVETAAGAQDGQRTSSGSDTDIYSFHSATEQEDLLSDIQQAIRLQQQQQQQLQLQLQQQQQQQQLQGAEEPAAPPTAVSPQPGAFLGLDRFLLGPSGGAGEAPGSPDTEQALSALSDLPESLAAEPREPQQPPSPGGLPVSEAPSLPAAQPAAKDSPSSTAFPFPEAGPGEEAAGAPVRGAGDTDEEGEEDAFEDAPRGSPGEEWAPEVGEDAPQRLGEEPEEEAQGPDAPAAASLPGSPAPSQRCFKPYPLITPCYIKTTTRQLSSPNHSPSQSPNQSPRIKRRPEPSLSRGSRTALASVAAPAKKHRADGGLAAGLSRSADWTEELGARTPRVGGSAHLLERGVASDSGGGVSPALAAKASGAPAAADGFQNVFTGRTLLEKLFSQQENGPPEEAEKFCSRIIAMGLLLPFSDCFREPCNQNAQTNAASFDQDQLYTWAAVSQPTHSLDYSEGQFPRRVPSMGPPSKPPDEEHRLEDAETESQSAVSETPQKRSDAVQKEVVDMKSEGQATVIQQLEQTIEDLRTKIAELERQYPALDTEVASGHQGLENGVTASGDVCLEALRLEEKEVRHHRILEAKSIQTSPTEEGGVLTLPPVDGLPGRPPCPPGAESGPQTKFCSEISLIVSPRRISVQLDSHQPTQSISQPPPPPSLLWSAGQGQPGSQPPHSISTEFQTSHEHSVSSAFKNSCNIPSPPPLPCTESSSSMPGLGMVPPPPPPLPGMTVPTLPSTAIPQPPPLQGTEMLPPPPPPLPGAGIPPPPPLPGAGILPLPPLPGAGIPPPPPLPGAAIPPPPPLPGAGIPLPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGVGIPPPPPLPGAGIPPPPPLPGAGIPPPPPLPGAGIPPPPPLPRVGIPPPPPLPGAGIPPPPPLPGAGIPPPPPLPGVGIPPPPPLPGVGIPPPPPLPGAGIPPPPPLPGMGIPPAPAPPLPPPGTGIPPPPLLPVSGPPLLPQVGSSTLPTPQVCGFLPPPLPSGLFGLGMNQDKGSRKQPIEPCRPMKPLYWTRIQLHSKRDSSTSLIWEKIEEPSIDCHEFEELFSKTAVKERKKPISDTISKTKAKQVVKLLSNKRSQAVGILMSSLHLDMKDIQHAVVNLDNSVVDLETLQALYENRAQSDELEKIEKHGRSSKDKENAKSLDKPEQFLYELSLIPNFSERVFCILFQSTFSESICSIRRKLELLQKLCETLKNGPGVMQVLGLVLAFGNYMNGGNKTRGQADGFGLDILPKLKDVKSSDNSRSLLSYIVSYYLRNFDEDAGKEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKAKISMKT

SEQ ID NO: 32707 - protein, 99 aa, Homo sapiens
  Payload ID: 6413
  Gene Symbol: FMN2
  Gene Name: formin 2
  ENSP ID: ENSP00000388922
MVVKLLSNKRSQAVGILMSSLHLDMKDIQHAVVNLDNSVVDLETLQALYENRAQSDELEKIEKHGRSSKDKENAKSLDKPEQFLYELSLIPNFSERVFC

SEQ ID NO: 32708 - protein, 228 aa, Homo sapiens
  Payload ID: 6413
  Gene Symbol: FMN2
  Gene Name: formin 2
  ENSP ID: ENSP00000409308
MGLLLPFSDCFREPCNQNAQTNAASFDQDQLYTWAAVSQPTHSLDYSEGQFPRRVPSMGPPSKPPDEEHRLEDAETEDDGESQSAVSETPQKRSDAVQKEVVDMKSEGQATVIQQLEQTIEDLRTKIAELERQYPALDTEVASGHQGLENGVTASGDVCLEALRLEEKEVRHHRILEAKSIQTSPTEEGGVLTLPPVDGLPGRPPCPPGAESGPQTKFCSEISLIVSP

SEQ ID NO: 32709 - protein, 198 aa, Homo sapiens
  Payload ID: 6413
  Gene Symbol: FMN2
  Gene Name: formin 2
  ENSP ID: ENSP00000437918
MSRAVTIAEAFCHILFRIISEILMRMLEEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKAKISMKT

SEQ ID NO: 32710 - protein, 42 aa, Homo sapiens
  Payload ID: 6413
  Gene Symbol: FMN2
  Gene Name: formin 2
  ENSP ID: ENSP00000439136
MCLLPIRVKEAEEVCRQKKGKSLYKIKPRHDSGIKAKISMKT

SEQ ID NO: 32711 - protein, 592 aa, Homo sapiens
  Payload ID: 6414
  Gene Symbol: FNBP1
  Gene Name: formin binding protein 1
  Uniprot ID: Q96RU3
  ENSP ID: ENSP00000347907
MSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKSPKQQKEPLSHRFNEFMTSKPKIHCFRSLKRGLSLKLGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKGAKTYI

SEQ ID NO: 32712 - protein, 551 aa, Homo sapiens
  Payload ID: 6414
  Gene Symbol: FNBP1
  Gene Name: formin binding protein 1
  ENSP ID: ENSP00000389117
MSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 32713 - protein, 612 aa, Homo sapiens
  Payload ID: 6414
  Gene Symbol: FNBP1
  Gene Name: formin binding protein 1
  Uniprot ID: Q96RU3
  ENSP ID: ENSP00000407548
MSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLMSLLTSPHQPPPPPPASASPSAVPNGPQSPKQQKEPLSHRFNEFMTSKPKIHCFRSLKRGGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 32714 - protein, 617 aa, Homo sapiens
  Payload ID: 6414
  Gene Symbol: FNBP1
  Gene Name: formin binding protein 1
  Uniprot ID: Q96RU3
  ENSP ID: ENSP00000413625
MSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLMSLLTSPHQPPPPPPASASPSAVPNGPQSPKQQKEPLSHRFNEFMTSKPKIHCFRSLKRGLSLKLGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 32715 - protein, 568 aa, Homo sapiens
  Payload ID: 6414
  Gene Symbol: FNBP1
  Gene Name: formin binding protein 1
  ENSP ID: ENSP00000415602
  MOD_RES (1)..(1): Any amino acid
XLSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKPPPPPPASASPSAVPNGPQSPKQQKEPLSHRFNEFMTSKPKIHCFRSLKRGGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKGAKTYI

SEQ ID NO: 32716 - protein, 551 aa, Homo sapiens
  Payload ID: 6415
  Gene Symbol: FNBP1L
  Gene Name: formin binding protein 1-like
  Uniprot ID: Q5T0N5
  ENSP ID: ENSP00000260506
MSWGTELWDQFDSLDKHTQWGIDFLERYAKFVKERIEIEQNYAKQLRNLVKKYCPKRSSKDEEPRFTSCVAFFNILNELNDYAGQREVVAEEMAHRVYGELMRYAHDLKTERKMHLQEGRKAQQYLDMCWKQMDNSKKKFERECREAEKAQQSYERLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGAVTYI

SEQ ID NO: 32717 - protein, 605 aa, Homo sapiens
  Payload ID: 6415
  Gene Symbol: FNBP1L
  Gene Name: formin binding protein 1-like
  Uniprot ID: Q5T0N5
  ENSP ID: ENSP00000271234
MSWGTELWDQFDSLDKHTQWGIDFLERYAKFVKERIEIEQNYAKQLRNLVKKYCPKRSSKDEEPRFTSCVAFFNILNELNDYAGQREVVAEEMAHRVYGELMRYAHDLKTERKMHLQEGRKAQQYLDMCWKQMDNSKKKFERECREAEKAQQSYERLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKPQSPPLTPTSLFTSSTPNGSQFLTFSIEPVHYCMNEIKTGKPRIPSFRSLKRGWSVKMGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGS

SEQ ID NO: 32718 - protein, 547 aa, Homo sapiens
  Payload ID: 6415
  Gene Symbol: FNBP1L
  Gene Name: formin binding protein 1-like
  Uniprot ID: Q5T0N5
  ENSP ID: ENSP00000359275
MSWGTELWDQFDSLDKHTQWGIDFLERYAKFVKERIEIEQNYAKQLRNLVKKYCPKRSSKDEEPRFTSCVAFFNILNELNDYAGQREVVAEEMAHRVYGELMRYAHDLKTERKMHLQEGRKAQQYLDMCWKQMDNSKKKFERECREAEKAQQSYERLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGS

SEQ ID NO: 32719 - protein, 451 aa, Homo sapiens
  Payload ID: 6415
  Gene Symbol: FNBP1L
  Gene Name: formin binding protein 1-like
  ENSP ID: ENSP00000397451
  MOD_RES (1)..(1): Any amino acid
XRLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKPQSPPLTPTSLFTSSTPNGSQFLTFSIEPVHYCMNEIKTGKPRIPSFRSLKRGWSVKMGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGS

SEQ ID NO: 32720 - protein, 609 aa, Homo sapiens
  Payload ID: 6415
  Gene Symbol: FNBP1L
  Gene Name: formin binding protein 1-like
  ENSP ID: ENSP00000473921
MSWGTELWDQFDSLDKHTQWGIDFLERYAKFVKERIEIEQNYAKQLRNLVKKYCPKRSSKDEEPRFTSCVAFFNILNELNDYAGQREVVAEEMAHRVYGELMRYAHDLKTERKMHLQEGRKAQQYLDMCWKQMDNSKKKFERECREAEKAQQSYERLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKPQSPPLTPTSLFTSSTPNGSQFLTFSIEPVHYCMNEIKTGKPRIPSFRSLKRGWSVKMGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGAVTYI

SEQ ID NO: 32721 - protein, 1017 aa, Homo sapiens
  Payload ID: 6416
  Gene Symbol: FNBP4
  Gene Name: formin binding protein 4
  Uniprot ID: Q8N3X1
  ENSP ID: ENSP00000263773
MGKKSRAVPGRRPILQLSPPGPRGSTPGRDPEPEPDTEPDSTAAVPSQPAPSAATTTTTAVTAAAASDDSPSEDEQEAVQEVPRVVQNPPKPVMTTRPTAVKATGGLCLLGAYADSDDDDNDVSEKLAQSKETNGNQSTDIDSTLANFLAEIDAITAPQPAAPVGASAPPPTPPRPEPKEAATSTLSSSTSNGTDSTQTSGWQYDTQCSLAGVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESPEKIKVQTTPKVEEEQDLKFQIGELANTLTSKFEFLGINRQSISNFHVLLLQTETRIADWREGALNGNYLKRKLQDAAEQLKQYEINATPKGWSCHWDRDHRRYFYVNEQSGESQWEFPDGEEEEEESQAQENRDETLAKQTLKDKTGTDSNSTESSETSTGSLCKESFSGQVSSSSLMPLTPFWTLLQSNVPVLQPPLPLEMPPPPPPPPESPPPPPPPPPPAEDGEIQEVEMEDEGSEEPPAPGTEEDTPLKPSAQTTVVTSQSSVDSTISSSSSTKGIKRKATEISTAVVQRSATIGSSPVLYSQSAIATGHQAAGIGNQATGIGHQTIPVSLPAAGMGHQARGMSLQSNYLGLAAAPAIMSYAECSVPIGVTAPSLQPVQARGAVPTATIIEPPPPPPPPPPPPPPAPKMPPPEKTKKGRKDKAKKSKTKMPSLVKKWQSIQRELDEEDNSSSSEEDRESTAQKRIEEWKQQQLVSGMAERNANFEALPEDWRARLKRRKMAPNT

SEQ ID NO: 32722 - protein, 143 aa, Homo sapiens
  Payload ID: 6416
  Gene Symbol: FNBP4
  Gene Name: formin binding protein 4
  ENSP ID: ENSP00000440181
MGKKSRAVPGRRPILQLSPPGPRGSTPGRDPEPEPDTEPDSTAAVPSQPAPSAATTTTTAVTAAAASDDSPSEDEQEAVQEVPRVVQNPPKPVMTTRPTAVKATGDRCHNSSSACSSCRSFCSTSNSTSTRAKGSSNIYPFFF

SEQ ID NO: 32723 - protein, 1164 aa, Homo sapiens
  Payload ID: 6417
  Gene Symbol: FHOD1
  Gene Name: formin homology 2 domain containing 1
  Uniprot ID: Q9Y613
  ENSP ID: ENSP00000258201
MAGGEDRGDGEPVSVVTVRVQYLEDTDPFACANFPEPRRAPTCSLDGALPLGAQIPAVHRLLGAPLKLEDCALQVSPSGYYLDTELSLEEQREMLEGFYEEISKGRKPTLILRTQLSVRVNAILEKLYSSSGPELRRSLFSLKQIFQEDKDLVPEFVHSEGLSCLIRVGAAADHNYQSYILRALGQLMLFVDGMLGVVAHSDTIQWLYTLCASLSRLVVKTALKLLLVFVEYSENNAPLFIRAVNSVASTTGAPPWANLVSILEEKNGADPELLVYTVTLINKTLAALPDQDSFYDVTDALEQQGMEALVQRHLGTAGTDVDLRTQLVLYENALKLEDGDIEEAPGAGGRRERRKPSSEEGKRSRRSLEGGGCPARAPEPGPTGPASPVGPTSSTGPALLTGPASSPVGPPSGLQASVNLFPTISVAPSADTSSERSIYKARFLENVAAAETEKQVALAQGRAETLAGAMPNEAGGHPDARQLWDSPETAPAARTPQSPAPCVLLRAQRSLAPEPKEPLIPASPKAEPIWELPTRAPRLSIGDLDFSDLGEDEDQDMLNVESVEAGKDIPAPSPPLPLLSGVPPPPPLPPPPPIKGPFPPPPPLPLAAPLPHSVPDSSALPTKRKTVKLFWRELKLAGGHGVSASRFGPCATLWASLDPVSVDTARLEHLFESRAKEVLPSKKAGEGRRTMTTVLDPKRSNAINIGLTTLPPVHVIKAALLNFDEFAVSKDGIEKLLTMMPTEEERQKIEEAQLANPDIPLGPAENFLMTLASIGGLAARLQLWAFKLDYDSMEREIAEPLFDLKVGMEQLVQNATFRCILATLLAVGNFLNGSQSSGFELSYLEKVSEVKDTVRRQSLLHHLCSLVLQTRPESSDLYSEIPALTRCAKVDFEQLTENLGQLERRSRAAEESLRSLAKHELAPALRARLTHFLDQCARRVAMLRIVHRRVCNRFHAFLLYLGYTPQAAREVRIMQFCHTLREFALEYRTCRERVLQQQQKQATYRERNKTRGRMITETEKFSGVAGEAPSNPSVPVAVSSGPGRGDADSHASMKSLLTSRPEDTTHNRRSRGMVQSSSPIMPTVGPSTASPEEPPGSSLPSDTSDEIMDLLVQSVTKSSPRALAARERKRSRGNRKSLRRTLKSGLGDDLVQALGLSKGPGLEV

SEQ ID NO: 32724 - protein, 157 aa, Homo sapiens
  Payload ID: 6417
  Gene Symbol: FHOD1
  Gene Name: formin homology 2 domain containing 1
  ENSP ID: ENSP00000458085
MAGGEDRGDGEPVSVVTVRVQYLEDTDPFACANFPEPRRAPTCSLDGALPLGAQIPAVHRLLGAPLKLEDCALQVSPSGYYLDTELSLEEQREMLEGFYEEISKGRKPTLILRTQLSVRVNAILGFYTLPFAEKLYSSSGPELRRSLFSLKQIFQRG

SEQ ID NO: 32725 - protein, 22 aa, Homo sapiens
  Payload ID: 6417
  Gene Symbol: FHOD1
  Gene Name: formin homology 2 domain containing 1
  ENSP ID: ENSP00000462807
  MOD_RES (1)..(1): Any amino acid
XSKDGIEMTEGSRPMPQASGLH

SEQ ID NO: 32726 - protein, 108 aa, Homo sapiens
  Payload ID: 6417
  Gene Symbol: FHOD1
  Gene Name: formin homology 2 domain containing 1
  ENSP ID: ENSP00000462988
GPCATLWASLDPVSVDTARLEHLFESRAKEVLPSKKAGEGRRTMTTVLDPKRSNAINIGLTTLPPVHVIKAALLNFDEFAVSKDGIEALATSSEATDHDAHGGRAAED

SEQ ID NO: 32727 - protein, 28 aa, Homo sapiens
  Payload ID: 6417
  Gene Symbol: FHOD1
  Gene Name: formin homology 2 domain containing 1
  ENSP ID: ENSP00000464011
  MOD_RES (1)..(1): Any amino acid
XFPTISVAPSADTSSERSIYKLHQTASV

SEQ ID NO: 32728 - protein, 1439 aa, Homo sapiens
  Payload ID: 6418
  Gene Symbol: FHOD3
  Gene Name: formin homology 2 domain containing 3
  Uniprot ID: Q2V2M9
  ENSP ID: ENSP00000257209
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKYSNFGNNSYHSSRPSSGSSVPTTPTSSVSPPQEARLERSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 32729 - protein, 1422 aa, Homo sapiens
  Payload ID: 6418
  Gene Symbol: FHOD3
  Gene Name: formin homology 2 domain containing 3
  Uniprot ID: Q2V2M9
  ENSP ID: ENSP00000352186
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKYSNFGNNSYHSSRPSSGSSVPTTPTSSVSPPQEARLERSSPSGLLTSSFRQHQESLAAERERRRQEREERLQRIEREERNKFRYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 32730 - protein, 375 aa, Homo sapiens
  Payload ID: 6418
  Gene Symbol: FHOD3
  Gene Name: formin homology 2 domain containing 3
  ENSP ID: ENSP00000465843
  MOD_RES (1)..(1): Any amino acid
XAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDDPLVPGLWELMTRPMSQMMQLMRSWTASSSQPPKCPVSEWCRGRGNDPGPTGNLCEEP

SEQ ID NO: 32731 - protein, 1622 aa, Homo sapiens
  Payload ID: 6418
  Gene Symbol: FHOD3
  Gene Name: formin homology 2 domain containing 3
  Uniprot ID: Q2V2M9
  ENSP ID: ENSP00000466937
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKEEEEEEEQPITEPSSEEEREDDASCQGKDSKVGAASGQSPTGRDAAPKSSALPAVSNASSQGKPLLVGTAGGTTWHSGSSGSEATPSALLSPPASAARPSSATPGSLKVSPTIDKLPYVPHSPFHLFSYDFEDSSLSTKEKEAESQKENSSSDSFSLSTYSASEPYHFRSFSSNRYSNFGNNSYHSSRPSSGSSVPTTPTSSVSPPQEARLERSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDTDEEEEVESGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 32732 - protein, 635 aa, Homo sapiens
  Payload ID: 6418
  Gene Symbol: FHOD3
  Gene Name: formin homology 2 domain containing 3
  ENSP ID: ENSP00000467195
MAMRPRSHPPVGAGTGGGPACVPVAEASTGAWTAEGAAGTRCRASRAPCRPPPVPAPSQLPASSPTKCEICVKNTAILAITLITPQDPHLDPVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 32733 - protein, 528 aa, Homo sapiens
  Payload ID: 6418
  Gene Symbol: FHOD3
  Gene Name: formin homology 2 domain containing 3
  ENSP ID: ENSP00000467462
RLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 32734 - protein, 1200 aa, Homo sapiens
  Payload ID: 6418
  Gene Symbol: FHOD3
  Gene Name: formin homology 2 domain containing 3
  ENSP ID: ENSP00000468163
  MOD_RES (1)..(1): Any amino acid
XFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 32735 - protein, 626 aa, Homo sapiens
  Payload ID: 6419
  Gene Symbol: FMNL1
  Gene Name: formin-like 1
  ENSP ID: ENSP00000327442
MGNAAGSAEQPAGPAAPPPKQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQAVPTGGL

SEQ ID NO: 32736 - protein, 1100 aa, Homo sapiens
  Payload ID: 6419
  Gene Symbol: FMNL1
  Gene Name: formin-like 1
  Uniprot ID: O95466
  ENSP ID: ENSP00000329219
MGNAAGSAEQPAGPAAPPPKQPAPPKQPMPAAGELEERFNRALNCMNLPPDKVQLLSQYDNEKKWELICDQERFQVKNPPAAYIQKLKSYVDTGGVSRKVAADWMSNLGFKRRVQESTQVLRELETSLRTNHIGWVQEFLNEENRGLDVLLEYLAFAQCSVTYDMESTDNGASNSEKNKPLEQSVEDLSKGPPSSVPKSRHLTIKLTPAHSRKALRNSRIVSQKDDVHVCIMCLRAIMNYQSGFSLVMNHPACVNEIALSLNNKNPRTKALVLELLAAVCLVRGGHDIILAAFDNFKEVCGEQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPLPGLPSPQEAPPSAPPQAPPLPGSPEPPPAPPLPGDLPPPPPPPPPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITVIKTVPFTARTGKRTSRLLCEASLGEEMPL

SEQ ID NO: 32737 - protein, 488 aa, Homo sapiens
  Payload ID: 6419
  Gene Symbol: FMNL1
  Gene Name: formin-like 1
  ENSP ID: ENSP00000465137
ELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITGKGLARPWSYPQSVLLCFLLTQCAILWGTGCHTASCYLFCFSFLFPFSTPLHLPHPHSVIKTVPFTARTGKRTSRLLCEASLGEEMPL

SEQ ID NO: 32738 - protein, 682 aa, Homo sapiens
  Payload ID: 6419
  Gene Symbol: FMNL1
  Gene Name: formin-like 1
  ENSP ID: ENSP00000465474
MAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPLPGLPSPQEAPPSAPPQAPPLPGSPEPPPAPPLPGDLPPPPPPPPPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 32739 - protein, 127 aa, Homo sapiens
  Payload ID: 6419
  Gene Symbol: FMNL1
  Gene Name: formin-like 1
  ENSP ID: ENSP00000466711
VRQDDCMVLKEFLRANSPTMDKLLADSKTAQKAEQEVEQWKKEAAAQEAGADTPGKGEPPAPKVGNCSWAWYWAAGMHGISSPSGATPTPSLLQTDPAPGAWDGKGFFLLKPAVLAVGDQADIPGFW

SEQ ID NO: 32740 - protein, 151 aa, Homo sapiens
  Payload ID: 6419
  Gene Symbol: FMNL1
  Gene Name: formin-like 1
  ENSP ID: ENSP00000468301
  MOD_RES (1)..(1): Any amino acid
XRQDDCMVLKEFLRANSPTMDKLLADSKTAQKAEQEVEQWKKEAAAQEAGADTPGKGEPPAPKSPPKARRPQMDLISELKRRQQKEPLIYESDRDGAIEDIITGKGLARPWSYPQSVLLCFLLTQCAILWGTGCHTASCYLFCFSFLFPFS

SEQ ID NO: 32741 - protein, 1092 aa, Homo sapiens
  Payload ID: 6420
  Gene Symbol: FMNL2
  Gene Name: formin-like 2
  Uniprot ID: Q96PY5
  ENSP ID: ENSP00000288670
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLDEYLDKLKHTESDKLQVQIQAYLDNVFDVGALLEDAETKNAALERVEELEENISHLSEKLQDTENEAMSKIVELEKQLMQRNKELDVVREIYKDANTQVHTLRKMVKEKEEAIQRQSTLEKKIHELEKQGTIKIQKKGDGDIAILPVVASGTLSMGSEVVAGNSVGPTMGAASSGPLPPPPPPLPPSSDTPETVQNGPVTPPMPPPPPPPPPPPPPPPPPPPPPLPGPAAETVPAPPLAPPLPSAPPLPGTSSPTVVFNSGLAAVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITDLRNQPYRRADAVRRSVRRRFDDQNLRSVNGAEITM

SEQ ID NO: 32742 - protein, 461 aa, Homo sapiens
  Payload ID: 6420
  Gene Symbol: FMNL2
  Gene Name: formin-like 2
  ENSP ID: ENSP00000418959
MPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITVLKTVPFTARTAKRGSRFFCEPVLTEEYHY

SEQ ID NO: 32743 - protein, 1027 aa, Homo sapiens
  Payload ID: 6421
  Gene Symbol: FMNL3
  Gene Name: formin-like 3
  Uniprot ID: Q8IVF7
  ENSP ID: ENSP00000335655
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITGLHCQPMVVRHQARSAAPPSGPPRAPGPH

SEQ ID NO: 32744 - protein, 976 aa, Homo sapiens
  Payload ID: 6421
  Gene Symbol: FMNL3
  Gene Name: formin-like 3
  Uniprot ID: Q8IVF7
  ENSP ID: ENSP00000344311
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITGLHCQPMVVRHQARSAAPPSGPPRAPGPH

SEQ ID NO: 32745 - protein, 1027 aa, Homo sapiens
  Payload ID: 6421
  Gene Symbol: FMNL3
  Gene Name: formin-like 3
  ENSP ID: ENSP00000447479
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITVLKSVPFTARTAKRGSRFFCDAAHHDESNC

SEQ ID NO: 32746 - protein, 55 aa, Homo sapiens
  Payload ID: 6421
  Gene Symbol: FMNL3
  Gene Name: formin-like 3
  ENSP ID: ENSP00000448939
MLRRVREGIGKSSMNLPPDKARLLRQYDNEKKWDLICDQERFQVKNPPHTYIQKL

SEQ ID NO: 32747 - protein, 350 aa, Homo sapiens
  Payload ID: 6422
  Gene Symbol: FPR1
  Gene Name: formyl peptide receptor 1
  Uniprot ID: P21462
  ENSP ID: ENSP00000302707
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAEVELQAK

SEQ ID NO: 32748 - protein, 39 aa, Homo sapiens
  Payload ID: 6422
  Gene Symbol: FPR1
  Gene Name: formyl peptide receptor 1
  ENSP ID: ENSP00000470750
METNSSLPTNISGGTPAVSAGYLFLDIITYLVFAVTFVL

SEQ ID NO: 32749 - protein, 350 aa, Homo sapiens; identical to SEQ ID NO: 32747
  Payload ID: 6422
  Gene Symbol: FPR1
  Gene Name: formyl peptide receptor 1
  Uniprot ID: P21462
  ENSP ID: ENSP00000471493

SEQ ID NO: 32750 - protein, 191 aa, Homo sapiens
  Payload ID: 6422
  Gene Symbol: FPR1
  Gene Name: formyl peptide receptor 1
  ENSP ID: ENSP00000472936
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERI

SEQ ID NO: 32751 - protein, 351 aa, Homo sapiens
  Payload ID: 6423
  Gene Symbol: FPR2
  Gene Name: formyl peptide receptor 2
  Uniprot ID: P25090
  ENSP ID: ENSP00000340191
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPLRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 32752 - protein, 351 aa, Homo sapiens; identical to SEQ ID NO: 32751
  Payload ID: 6423
  Gene Symbol: FPR2
  Gene Name: formyl peptide receptor 2
  Uniprot ID: P25090
  ENSP ID: ENSP00000468876

SEQ ID NO: 32753 - protein, 351 aa, Homo sapiens; identical to SEQ ID NO: 32751
  Payload ID: 6423
  Gene Symbol: FPR2
  Gene Name: formyl peptide receptor 2
  Uniprot ID: P25090
  ENSP ID: ENSP00000468897

SEQ ID NO: 32754 - protein, 136 aa, Homo sapiens
  Payload ID: 6423
  Gene Symbol: FPR2
  Gene Name: formyl peptide receptor 2
  ENSP ID: ENSP00000469085
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNH

SEQ ID NO: 32755 - protein, 88 aa, Homo sapiens
  Payload ID: 6423
  Gene Symbol: FPR2
  Gene Name: formyl peptide receptor 2
  ENSP ID: ENSP00000470373
METNFSTPLNEYEEVSYESAGYTVLRILPLVVLGVTFVLGVLGNGLVIWVAGFRMTRTVTTICYLNLALADFSFTATLPFLIVSMAMG

SEQ ID NO: 32756 - protein, 124 aa, Homo sapiens
  Payload ID: 6423
  Gene Symbol: FPR2
  Gene Name: formyl peptide receptor 2
  ENSP ID: ENSP00000472259
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRC

SEQ ID NO: 32757 - protein, 353 aa, Homo sapiens
  Payload ID: 6424
  Gene Symbol: FPR3
  Gene Name: formyl peptide receptor 3
  Uniprot ID: P25089
  ENSP ID: ENSP00000341821
METNFSIPLNETEEVLPEPAGHTVLWIFSLLVHGVTFVFGVLGNGLVIWVAGFRMTRTVNTICYLNLALADFSFSAILPFRMVSVAMREKWPFGSFLCKLVHVMIDINLFVSVYLITIIALDRCICVLHPAWAQNHRTMSLAKRVMTGLWIFTIVLTLPNFIFWTTISTTNGDTYCIFNFAFWGDTAVERLNVFITMAKVFLILHFIIGFSVPMSIITVCYGIIAAKIHRNHMIKSSRPLRVFAAVVASFFICWFPYELIGILMAVWLKEMLLNGKYKIILVLINPTSSLAFFNSCLNPILYVFMGRNFQERLIRSLPTSLERALTEVPDSAQTSNTDTTSASPPEETELQAM

SEQ ID NO: 32758 - protein, 353 aa, Homo sapiens; identical to SEQ ID NO: 32757
  Payload ID: 6424
  Gene Symbol: FPR3
  Gene Name: formyl peptide receptor 3
  Uniprot ID: P25089
  ENSP ID: ENSP00000470471

SEQ ID NO: 32759 - protein, 318 aa, Homo sapiens
  Payload ID: 6425
  Gene Symbol: FYTTD1
  Gene Name: forty-two-three domain containing 1
  Uniprot ID: Q96QD9
  ENSP ID: ENSP00000241502
MNRFGTRLVGATATSSPPPKARSNENLDKIDMSLDDIIKLNRKEGKKQNFPRLNRRLLQQSGAQQFRMRVRWGIQQNSGFGKTSLNRRGRVMPGKRRPNGVITGLAARKTTGIRKGISPMNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 32760 - protein, 71 aa, Homo sapiens
  Payload ID: 6425
  Gene Symbol: FYTTD1
  Gene Name: forty-two-three domain containing 1
  ENSP ID: ENSP00000389557
MRVRWGIQQNSGFGKTSLNRRGRVMPGKRRPNGVITGLAARKTTGIRKGISPMNRPPLSDKNIEQYFPVLK

SEQ ID NO: 32761 - protein, 292 aa, Homo sapiens
  Payload ID: 6425
  Gene Symbol: FYTTD1
  Gene Name: forty-two-three domain containing 1
  Uniprot ID: Q96QD9
  ENSP ID: ENSP00000393746
MEPSVIMGNDIIKLNRKEGKKQNFPRLNRRLLQQSGAQQFRMRVRWGIQQNSGFGKTSLNRRGRVMPGKRRPNGVITGLAARKTTGIRKGISPMNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 32762 - protein, 251 aa, Homo sapiens
  Payload ID: 6425
  Gene Symbol: FYTTD1
  Gene Name: forty-two-three domain containing 1
  Uniprot ID: Q96QD9
  ENSP ID: ENSP00000394631
MRVRWGIQQNSGFGKTSLNRRGRVMPGKRRPNGVITGLAARKTTGIRKGISPMNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 32763 - protein, 176 aa, Homo sapiens
  Payload ID: 6425
  Gene Symbol: FYTTD1
  Gene Name: forty-two-three domain containing 1
  ENSP ID: ENSP00000399896
MRVRWGIQQNSGFGKTSLNRRGRVMPGKRRPNGVITGLAARKTTGIRKGISPMNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCP

SEQ ID NO: 32764 - protein, 129 aa, Homo sapiens
  Payload ID: 6425
  Gene Symbol: FYTTD1
  Gene Name: forty-two-three domain containing 1
  Uniprot ID: Q96QD9
  ENSP ID: ENSP00000400191
MNRFGTRLVGATATSSPPPKARSNENLDKIDMSLDDIIKLNRKEGKKQNFPRLNRRLLQQSGAQQFRMRVRWGIQQNSGFGKTSLNRRGRVMPGKRRPNGVITGLAARKTTGIRKGISPMNRPPLSDKK

SEQ ID NO: 32765 - protein, 121 aa, Homo sapiens
  Payload ID: 6425
  Gene Symbol: FYTTD1
  Gene Name: forty-two-three domain containing 1
  ENSP ID: ENSP00000409257
MNRFGTRLVGATATSSPPPKARSNENLDKIDMSLDDIIKLNRKEGKKQNFPRLNRRLLQQSGAQQFRMRVRWGIQQNSDTKTLESSIVKHMKRFVLVIPALWEVRARGLLKPRTSGPAWAT

SEQ ID NO: 32766 - protein, 126 aa, Homo sapiens
  Payload ID: 6425
  Gene Symbol: FYTTD1
  Gene Name: forty-two-three domain containing 1
  ENSP ID: ENSP00000417742
GCVAVGAKGSCVPKYRGPVCSRRDSKDTEDYITEGIRFRDDIIKLNRKEGKKQNFPRLNRRLLQQSGAQQFRMRVRWGIQQNSDTKTLESSIVKHMKRFVLVIPALWEVRARGLLKPRTSGPAWAT

SEQ ID NO: 32767 - protein, 271 aa, Homo sapiens
  Payload ID: 6426
  Gene Symbol: FOSL1
  Gene Name: FOS-like antigen 1
  Uniprot ID: P15407
  ENSP ID: ENSP00000310170
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQISPEEEERRRVRRERNKLAAAKCRNRRKELTDFLQAETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 32768 - protein, 169 aa, Homo sapiens
  Payload ID: 6426
  Gene Symbol: FOSL1
  Gene Name: FOS-like antigen 1
  Uniprot ID: P15407
  ENSP ID: ENSP00000393302
MFRDFGEPGPSSGNGGGYGGPAQPPAAAQAAQQETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 32769 - protein, 135 aa, Homo sapiens
  Payload ID: 6426
  Gene Symbol: FOSL1
  Gene Name: FOS-like antigen 1
  ENSP ID: ENSP00000431594
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQPGGRGAPPSKARAEQAGCGQVQEPEEGTDRLPAGGD

SEQ ID NO: 32770 - protein, 12 aa, Homo sapiens
  Payload ID: 6426
  Gene Symbol: FOSL1
  Gene Name: FOS-like antigen 1
  ENSP ID: ENSP00000434350
MTTPSLTPFTPS

SEQ ID NO: 32771 - protein, 235 aa, Homo sapiens
  Payload ID: 6426
  Gene Symbol: FOSL1
  Gene Name: FOS-like antigen 1
  ENSP ID: ENSP00000436276
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 32772 - protein, 326 aa, Homo sapiens
  Payload ID: 6427
  Gene Symbol: FOSL2
  Gene Name: FOS-like antigen 2
  Uniprot ID: P15408
  ENSP ID: ENSP00000264716
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 32773 - protein, 318 aa, Homo sapiens
  Payload ID: 6427
  Gene Symbol: FOSL2
  Gene Name: FOS-like antigen 2
  Uniprot ID: P15408
  ENSP ID: ENSP00000368939
MVQGWRIKSKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAIGPWQVAVPHIPLFPWQETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 32774 - protein, 202 aa, Homo sapiens
  Payload ID: 6427
  Gene Symbol: FOSL2
  Gene Name: FOS-like antigen 2
  ENSP ID: ENSP00000396497
MPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKA

SEQ ID NO: 32775 - protein, 323 aa, Homo sapiens
  Payload ID: 6428
  Gene Symbol: FHL1
  Gene Name: four and a half LIM domains 1
  Uniprot ID: Q13642
  ENSP ID: ENSP00000071281
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGKRTVSRVSHPVSKARKPPVCHGKRLPLTLFPSANLRGRHPGGERTCPSWVVVLYRKNRSLAAPRGPGLVKAPVWWPMKDNPGTTTASTAKNAP

SEQ ID NO: 32776 - protein, 257 aa, Homo sapiens
  Payload ID: 6428
  Gene Symbol: FHL1
  Gene Name: four and a half LIM domains 1
  ENSP ID: ENSP00000359708
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSV

SEQ ID NO: 32777 - protein, 210 aa, Homo sapiens
  Payload ID: 6428
  Gene Symbol: FHL1
  Gene Name: four and a half LIM domains 1
  ENSP ID: ENSP00000359710
MASHRHSGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKGLVKAPVWWPMKDNPGTTTASTAKNAP

SEQ ID NO: 32778 - protein, 296 aa, Homo sapiens
  Payload ID: 6428
  Gene Symbol: FHL1
  Gene Name: four and a half LIM domains 1
  Uniprot ID: Q13642
  ENSP ID: ENSP00000359717
MASHRHSGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 32779 - protein, 280 aa, Homo sapiens
  Payload ID: 6428
  Gene Symbol: FHL1
  Gene Name: four and a half LIM domains 1
  Uniprot ID: Q13642
  ENSP ID: ENSP00000359724
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 32780 - protein, 280 aa, Homo sapiens; identical to SEQ ID NO: 32779
  Payload ID: 6428
  Gene Symbol: FHL1
  Gene Name: four and a half LIM domains 1
  Uniprot ID: Q13642
  ENSP ID: ENSP00000377709

SEQ ID NO: 32781 - protein, 323 aa, Homo sapiens; identical to SEQ ID NO: 32775
  Payload ID: 6428
  Gene Symbol: FHL1
  Gene Name: four and a half LIM domains 1
  Uniprot ID: Q13642
  ENSP ID: ENSP00000377710

SEQ ID NO: 32782 - protein, 155 aa, Homo sapiens
  Payload ID: 6428
  Gene Symbol: FHL1
  Gene Name: four and a half LIM domains 1
  ENSP ID: ENSP00000389920
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHE

SEQ ID NO: 32783 - protein, 204 aa, Homo sapiens
  Payload ID: 6428
  Gene Symbol: FHL1
  Gene Name: four and a half LIM domains 1
  ENSP ID: ENSP00000391779
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVE

SEQ ID NO: 32784 - protein, 207 aa, Homo sapiens
  Payload ID: 6428
  Gene Symbol: FHL1
  Gene Name: four and a half LIM domains 1
  ENSP ID: ENSP00000408038
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQY

SEQ ID NO: 32785 - protein, 205 aa, Homo sapiens
  Payload ID: 6428
  Gene Symbol: FHL1
  Gene Name: four and a half LIM domains 1
  ENSP ID: ENSP00000412642
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVED

SEQ ID NO: 32786 - protein, 207 aa, Homo sapiens; identical to SEQ ID NO: 32784
  Payload ID: 6428
  Gene Symbol: FHL1
  Gene Name: four and a half LIM domains 1
  ENSP ID: ENSP00000413798

SEQ ID NO: 32787 - protein, 141 aa, Homo sapiens
  Payload ID: 6428
  Gene Symbol: FHL1
  Gene Name: four and a half LIM domains 1
  ENSP ID: ENSP00000414604
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSF

SEQ ID NO: 32788 - protein, 309 aa, Homo sapiens
  Payload ID: 6428
  Gene Symbol: FHL1
  Gene Name: four and a half LIM domains 1
  Uniprot ID: Q13642
  ENSP ID: ENSP00000437673
MTFYVASLALELIWMLSSPAGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 32789 - protein, 280 aa, Homo sapiens; identical to SEQ ID NO: 32779
  Payload ID: 6428
  Gene Symbol: FHL1
  Gene Name: four and a half LIM domains 1
  Uniprot ID: Q13642
  ENSP ID: ENSP00000443333

SEQ ID NO: 32790 - protein, 280 aa, Homo sapiens; identical to SEQ ID NO: 32779
  Payload ID: 6428
  Gene Symbol: FHL1
  Gene Name: four and a half LIM domains 1
  Uniprot ID: Q13642
  ENSP ID: ENSP00000444815

SEQ ID NO: 32791 - protein, 194 aa, Homo sapiens
  Payload ID: 6428
  Gene Symbol: FHL1
  Gene Name: four and a half LIM domains 1
  Uniprot ID: Q13642
  ENSP ID: ENSP00000477609
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKGLVKAPVWWPMKDNPGTTTASTAKNAP

SEQ ID NO: 32792 - protein, 280 aa, Homo sapiens; identical to SEQ ID NO: 32779
  Payload ID: 6428
  Gene Symbol: FHL1
  Gene Name: four and a half LIM domains 1
  Uniprot ID: Q13642
  ENSP ID: ENSP00000485897

SEQ ID NO: 32793 - protein, 66 aa, Homo sapiens
  Payload ID: 6428
  Gene Symbol: FHL1
  Gene Name: four and a half LIM domains 1
  ENSP ID: ENSP00000486134
MAEKFDCHYCRDPLQGKKYVQKDGHHCCLKCFDKFCANTCVECRKPIGADSKEVHYKNRFWHDTCF

SEQ ID NO: 32794 - protein, 152 aa, Homo sapiens
  Payload ID: 6428
  Gene Symbol: FHL1
  Gene Name: four and a half LIM domains 1
  ENSP ID: ENSP00000486436
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVT

SEQ ID NO: 32795 - protein, 280 aa, Homo sapiens; identical to SEQ ID NO: 32779
  Payload ID: 6428
  Gene Symbol: FHL1
  Gene Name: four and a half LIM domains 1
  Uniprot ID: Q13642
  ENSP ID: ENSP00000486439

SEQ ID NO: 32796 - protein, 147 aa, Homo sapiens
  Payload ID: 6428
  Gene Symbol: FHL1
  Gene Name: four and a half LIM domains 1
  ENSP ID: ENSP00000486631
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGED

SEQ ID NO: 32797 - protein, 280 aa, Homo sapiens; identical to SEQ ID NO: 32779
  Payload ID: 6428
  Gene Symbol: FHL1
  Gene Name: four and a half LIM domains 1
  Uniprot ID: Q13642
  ENSP ID: ENSP00000486782

SEQ ID NO: 32798 - protein, 175 aa, Homo sapiens
  Payload ID: 6428
  Gene Symbol: FHL1
  Gene Name: four and a half LIM domains 1
  ENSP ID: ENSP00000487030
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGIT

SEQ ID NO: 32799 - protein, 130 aa, Homo sapiens
  Payload ID: 6428
  Gene Symbol: FHL1
  Gene Name: four and a half LIM domains 1
  ENSP ID: ENSP00000487147
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCS

SEQ ID NO: 32800 - protein, 138 aa, Homo sapiens
  Payload ID: 6428
  Gene Symbol: FHL1
  Gene Name: four and a half LIM domains 1
  ENSP ID: ENSP00000487318
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGT

SEQ ID NO: 32801 - protein, 18 aa, Homo sapiens
  Payload ID: 6428
  Gene Symbol: FHL1
  Gene Name: four and a half LIM domains 1
  ENSP ID: ENSP00000487360
MAEKFDCHYCRDPLQGKK

SEQ ID NO: 32802 - protein, 78 aa, Homo sapiens
  Payload ID: 6428
  Gene Symbol: FHL1
  Gene Name: four and a half LIM domains 1
  ENSP ID: ENSP00000487377
MAEKFDCHYCRDPLQGKKYVQKDGHHCCLKCFDKFCANTCVECRKPIGADSKEVHYKNRFWHDTCFRCAKCLHPLANE

SEQ ID NO: 32803 - protein, 279 aa, Homo sapiens
  Payload ID: 6429
  Gene Symbol: FHL2
  Gene Name: four and a half LIM domains 2
  Uniprot ID: Q14192
  ENSP ID: ENSP00000322909
MTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 32804 - protein, 389 aa, Homo sapiens
  Payload ID: 6429
  Gene Symbol: FHL2
  Gene Name: four and a half LIM domains 2
  ENSP ID: ENSP00000344266
MTRRGFSRAGAAQRSTRPAAEPQPPAARALQPRPGVPGPLRCREYLQPPAPRREAEGLSHQGSEVGAESGARPKERGAEPELGRLWLRTVSSWRLGWHFDFGVAEKPGVKMTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 32805 - protein, 151 aa, Homo sapiens
  Payload ID: 6429
  Gene Symbol: FHL2
  Gene Name: four and a half LIM domains 2
  Uniprot ID: Q14192
  ENSP ID: ENSP00000350846
MTERFDCHHCNESLFGKKYILREESPYCVVCFETLFANTCEECGKPIGCDCKVPARWSTRAAAGMRPASSATAASSQLEPRVSSPKTIRISVCPAMRNNMPCSAFSAKSPSPREGSLTGSSPGTRSASCAPPAGSSCLGSASQLAMTLPTA

SEQ ID NO: 32806 - protein, 279 aa, Homo sapiens; identical to SEQ ID NO: 32803
  Payload ID: 6429
  Gene Symbol: FHL2
  Gene Name: four and a half LIM domains 2
  Uniprot ID: Q14192
  ENSP ID: ENSP00000377020

SEQ ID NO: 32807 - protein, 279 aa, Homo sapiens; identical to SEQ ID NO: 32803
  Payload ID: 6429
  Gene Symbol: FHL2
  Gene Name: four and a half LIM domains 2
  Uniprot ID: Q14192
  ENSP ID: ENSP00000377021

SEQ ID NO: 32808 - protein, 279 aa, Homo sapiens; identical to SEQ ID NO: 32803
  Payload ID: 6429
  Gene Symbol: FHL2
  Gene Name: four and a half LIM domains 2
  Uniprot ID: Q14192
  ENSP ID: ENSP00000386633

SEQ ID NO: 32809 - protein, 279 aa, Homo sapiens; identical to SEQ ID NO: 32803
  Payload ID: 6429
  Gene Symbol: FHL2
  Gene Name: four and a half LIM domains 2
  Uniprot ID: Q14192
  ENSP ID: ENSP00000386665

SEQ ID NO: 32810 - protein, 395 aa, Homo sapiens
  Payload ID: 6429
  Gene Symbol: FHL2
  Gene Name: four and a half LIM domains 2
  ENSP ID: ENSP00000386892
MVICGVHFVKKHLQGKKEKRPPCKYIPGTCLLRSDPLLPPPPPARPGASPVSRSWDQAEIPAWADPCHRAQASSETRAREPTPEATLPITTVLPRPGGHEERSPGKQRVAEKPGVKMTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 32811 - protein, 19 aa, Homo sapiens
  Payload ID: 6429
  Gene Symbol: FHL2
  Gene Name: four and a half LIM domains 2
  ENSP ID: ENSP00000397083
MTERFDCHHCNESLFGKKY

SEQ ID NO: 32812 - protein, 54 aa, Homo sapiens
  Payload ID: 6429
  Gene Symbol: FHL2
  Gene Name: four and a half LIM domains 2
  ENSP ID: ENSP00000414872
MTERFDCHHCNESLFGKKYILREESPYCVVCFETLFANTCEECGKPIGCDCKAC

SEQ ID NO: 32813 - protein, 144 aa, Homo sapiens
  Payload ID: 6429
  Gene Symbol: FHL2
  Gene Name: four and a half LIM domains 2
  ENSP ID: ENSP00000433567
MTRRGFSRAGAAQRSTRPAAEPQPPAARALQPRPGVPGPLRCREYLQPPAPRREAEGLSHQGSEVGAESGARPKERGAEPELGRLWLRTVSSWRLGWHFDFGTESRFVAQAGVQWHDLSSLQALPLGSRHSPAPASQVAGTTGC

SEQ ID NO: 32814 - protein, 65 aa, Homo sapiens
  Payload ID: 6429
  Gene Symbol: FHL2
  Gene Name: four and a half LIM domains 2
  ENSP ID: ENSP00000476199
MTERFDCHHCNESLFGKKYILREESPYCVVCFETLFANTCEECGKPIGCDCKVPAAGLCGSPALP

SEQ ID NO: 32815 - protein, 280 aa, Homo sapiens
  Payload ID: 6430
  Gene Symbol: FHL3
  Gene Name: four and a half LIM domains 3
  Uniprot ID: Q13643
  ENSP ID: ENSP00000362107
MSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 32816 - protein, 284 aa, Homo sapiens
  Payload ID: 6431
  Gene Symbol: FHL5
  Gene Name: four and a half LIM domains 5
  Uniprot ID: Q5TD97
  ENSP ID: ENSP00000326022
MTTAHFYCQYCTASLLGKKYVLKDDSPYCVTCYDRVFSNYCEECKKPIESDSKDLCYKDRHWHEGCFKCTKCNHSLVEKPFAAKDERLLCTECYSNECSSKCFHCKRTIMPGSRKMEFKGNYWHETCFVCENCRQPIGTKPLISKESGNYCVPCFEKEFAHYCNFCKKVITSGGITFCDQLWHKECFLCSGCRKDLCEEQFMSRDDYPFCVDCYNHLYANKCVACSKPISGLTGAKFICFQDSQWHSECFNCGKCSVSLVGKGFLTQNKEIFCQKCGSGMDTDI

SEQ ID NO: 32817 - protein, 210 aa, Homo sapiens
  Payload ID: 6431
  Gene Symbol: FHL5
  Gene Name: four and a half LIM domains 5
  ENSP ID: ENSP00000396390
MTTAHFYCQYCTASLLGKKYVLKDDSPYCVTCYDRVFSNYCEECKKPIESDSKDLCYKDRHWHEGCFKCTKCNHSLVEKPFAAKDERLLCTECYSNECSSKCFHCKRTIMPGSRKMEFKGNYWHETCFVCENCRQPIGTKPLISKESGNYCVPCFEKEFAHYCNFCKKVITSGGITFCDQLWHKECFLCSGCRKDLCEEQFMSRDDYPFC

SEQ ID NO: 32818 - protein, 284 aa, Homo sapiens; identical to SEQ ID NO: 32816
  Payload ID: 6431
  Gene Symbol: FHL5
  Gene Name: four and a half LIM domains 5
  Uniprot ID: Q5TD97
  ENSP ID: ENSP00000442357

SEQ ID NO: 32819 - protein, 437 aa, Homo sapiens
  Payload ID: 6432
  Gene Symbol: FJX1
  Gene Name: four jointed box 1
  Uniprot ID: Q86VR8
  ENSP ID: ENSP00000400223
MGRRMRGAAATAGLWLLALGSLLALWGGLLPPRTELPASRPPEDRLPRRPARSGGPAPAPRFPLPPPLAWDARGGSLKTFRALLTLAAGADGPPRQSRSEPRWHVSARQPRPEESAAVHGGVFWSRGLEEQVPPGFSEAQAAAWLEAARGARMVALERGGCGRSSNRLARFADGTRACVRYGINPEQIQGEALSYYLARLLGLQRHVPPLALARVEARGAQWAQVQEELRAAHWTEGSVVSLTRWLPNLTDVVVPAPWRSEDGRLRPLRDAGGELANLSQAELVDLVQWTDLILFDYLTANFDRLVSNLFSLQWDPRVMQRATSNLHRGPGGALVFLDNEAGLVHGYRVAGMWDKYNEPLLQSVCVFRERTARRVLELHRGQDAAARLLRLYRRHEPRFPELAALADPHAQLLQRRLDFLAKHILHCKAKYGRRSGT

SEQ ID NO: 32820 - protein, 175 aa, Homo sapiens
  Payload ID: 6433
  Gene Symbol: FOXL2NB
  Gene Name: FOXL2 neighbor
  Uniprot ID: Q6ZUU3
  ENSP ID: ENSP00000372651
MTRTPVGSARTRPKPRKLGPQRGKALQASSRLSESPALVKKRMPDACTLGRAGIGLPKMCLHMAVRHSKAQKTGPGILQQRQKPPAPRASGGPALLGKRRGCSEAGSASLEPLSSSRAAAGCLNQVPLSPFLAGPRNTRRLPAPERERIELAATLCLEGWPLRCLASKGKLHCVY

SEQ ID NO: 32821 - protein, 41 aa, Homo sapiens
  Payload ID: 6433
  Gene Symbol: FOXL2NB
  Gene Name: FOXL2 neighbor
  ENSP ID: ENSP00000418272
MTRTPVGSARTRPKPRKLGPQRGKALQASSRLSEEQNPQPW

SEQ ID NO: 32822 - protein, 165 aa, Homo sapiens
  Payload ID: 6434
  Gene Symbol:
  Gene Name: FP325317.1
  ENSP ID: ENSP00000439534
MNAAVSFTNCALGRVPWRKFPVYVLGQFLGSFLAAATIYRLFYMAILHFSGGELMVTGPVATAGIFATYLPDHMTLWRGFLNEEWLTGMLQLCLFAITDREKNPALPGTHALVIGILVVIIRVSHGMNTGYAINPSRDLPPRIFTFIAGWGKQVFRYFPCPGPFL

SEQ ID NO: 32823 - protein, 151 aa, Homo sapiens
  Payload ID: 6435
  Gene Symbol: FPGT-TNNI3K
  Gene Name: FPGT-TNNI3K readthrough
  ENSP ID: ENSP00000359930
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFG

SEQ ID NO: 32824 - protein, 697 aa, Homo sapiens
  Payload ID: 6435
  Gene Symbol: FPGT-TNNI3K
  Gene Name: FPGT-TNNI3K readthrough
  ENSP ID: ENSP00000359932
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNRYFFPK

SEQ ID NO: 32825 - protein, 843 aa, Homo sapiens
  Payload ID: 6435
  Gene Symbol: FPGT-TNNI3K
  Gene Name: FPGT-TNNI3K readthrough
  ENSP ID: ENSP00000359936
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEAKSRPSHYPVSSVYTETLKKKNEDRFGMWIEYLRR

SEQ ID NO: 32826 - protein, 162 aa, Homo sapiens
  Payload ID: 6435
  Gene Symbol: FPGT-TNNI3K
  Gene Name: FPGT-TNNI3K readthrough
  ENSP ID: ENSP00000433587
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSGHDAIVTLLKHYKRPQDELPCNEYSQPGGDGSYVSVPSPLGKIKSMTK

SEQ ID NO: 32827 - protein, 949 aa, Homo sapiens
  Payload ID: 6435
  Gene Symbol: FPGT-TNNI3K
  Gene Name: FPGT-TNNI3K readthrough
  ENSP ID: ENSP00000450895
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEGRPEFSEVVMKLEECLCNIELMSPASSNSSGSLSPSSSSDCLVNRGGPGRSHVAALRSRFELEYALNARSYAALSQSAGQYSSQGLSLEEMKRSLQYTPIDKYGYVSDPMSSMHFHSCRNSSSFEDSS

SEQ ID NO: 32828 - protein, 58 aa, Homo sapiens
  Payload ID: 6436
  Gene Symbol: FHIT
  Gene Name: fragile histidine triad
  ENSP ID: ENSP00000342087
VLVCPLRPVERFHDLRPDEVADLFQTTQRVGTVVEKHFHGTSLTFSMQDGPEAGQTVK

SEQ ID NO: 32829 - protein, 147 aa, Homo sapiens
  Payload ID: 6436
  Gene Symbol: FHIT
  Gene Name: fragile histidine triad
  Uniprot ID: P49789
  ENSP ID: ENSP00000417480
MSFRFGQHLIKPSVVFLKTELSFALVNRKPVVPGHVLVCPLRPVERFHDLRPDEVADLFQTTQRVGTVVEKHFHGTSLTFSMQDGPEAGQTVKHVHVHVLPRKAGDFHRNDSIYEELQKHDKEDFPASWRSEEEMAAEAAALRVYFQ

SEQ ID NO: 32830 - protein, 147 aa, Homo sapiens; identical to SEQ ID NO: 32829
  Payload ID: 6436
  Gene Symbol: FHIT
  Gene Name: fragile histidine triad
  Uniprot ID: P49789
  ENSP ID: ENSP00000417557

SEQ ID NO: 32831 - protein, 147 aa, Homo sapiens; identical to SEQ ID NO: 32829
  Payload ID: 6436
  Gene Symbol: FHIT
  Gene Name: fragile histidine triad
  Uniprot ID: P49789
  ENSP ID: ENSP00000418582

SEQ ID NO: 32832 - protein, 78 aa, Homo sapiens
  Payload ID: 6436
  Gene Symbol: FHIT
  Gene Name: fragile histidine triad
  ENSP ID: ENSP00000418596
MSFRFGQHLIKPSVVFLKTELSFALVNRKPVVPGHVLVCPLRPVERFHDLRPDEVADLFQTTQRVGTVVEKHFHGTSL

SEQ ID NO: 32833 - protein, 315 aa, Homo sapiens
  Payload ID: 6437
  Gene Symbol: FRA10AC1
  Gene Name: fragile site, folic acid type, rare, fra(10)(q23.3) or fra(10)(q24.2) candidate 1
  Uniprot ID: Q70Z53
  ENSP ID: ENSP00000360488
MHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLRNSDEEESASESELWKGPLPETDEKSQEEEFDEYFQDLFL

SEQ ID NO: 32834 - protein, 611 aa, Homo sapiens
  Payload ID: 6438
  Gene Symbol: FMR1
  Gene Name: fragile X mental retardation 1
  Uniprot ID: Q06787
  ENSP ID: ENSP00000218200
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQIRVDCNNERSVHTKTLQNTSSEGSRLRTGKDRNQKKEKPDSVDGQQPLVNGVP

SEQ ID NO: 32835 - protein, 297 aa, Homo sapiens
  Payload ID: 6438
  Gene Symbol: FMR1
  Gene Name: fragile X mental retardation 1
  ENSP ID: ENSP00000355115
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGLKI

SEQ ID NO: 32836 - protein, 590 aa, Homo sapiens
  Payload ID: 6438
  Gene Symbol: FMR1
  Gene Name: fragile X mental retardation 1
  Uniprot ID: Q06787
  ENSP ID: ENSP00000359501
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRVLVASSVVAGESQKPELKAWQGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 32837 - protein, 537 aa, Homo sapiens
  Payload ID: 6438
  Gene Symbol: FMR1
  Gene Name: fragile X mental retardation 1
  ENSP ID: ENSP00000359502
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRVLVASSVVAGESQKPELKAWQGMVPFVFVGTKDSIANATVLLDYHLNYLKLQQRKRGRASCAEETDGGVEGEEEDKEEEDVEEASKETTITPEQIIVHVIQERLKEEQQMDPFRSELTAIMKGVSTLKHYRIPPVKVVGCARVKIVTRRKRSQTAWMVSNHS

SEQ ID NO: 32838 - protein, 632 aa, Homo sapiens [sequence omitted]

SEQ ID NO: 32839 - protein, 582 aa, Homo sapiens
  Payload ID: 6438
  Gene Symbol: FMR1
  Gene Name: fragile X mental retardation 1
  ENSP ID: ENSP00000359508
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSESDHRDELSDWSLAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 32840 - protein, 592 aa, Homo sapiens
  Payload ID: 6438
  Gene Symbol: FMR1
  Gene Name: fragile X mental retardation 1
  ENSP ID: ENSP00000395923
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 32841 - protein, 586 aa, Homo sapiens
  Payload ID: 6438
  Gene Symbol: FMR1
  Gene Name: fragile X mental retardation 1
  Uniprot ID: Q06787
  ENSP ID: ENSP00000413764
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSAPTEEERESFLRRGDGRRRGGGGRGQGGRGRGGGFKGNDDHSRTDNRPRNPREAKGRTTDGSLQIRVDCNNERSVHTKTLQNTSSEGSRLRTGKDRNQKKEKPDSVDGQQPLVNGVP

SEQ ID NO: 32842 - protein, 297 aa, Homo sapiens; identical to SEQ ID NO: 32835
  Payload ID: 6438
  Gene Symbol: FMR1
  Gene Name: fragile X mental retardation 1
  ENSP ID: ENSP00000477839

SEQ ID NO: 32843 - protein, 544 aa, Homo sapiens
  Payload ID: 6438
  Gene Symbol: FMR1
  Gene Name: fragile X mental retardation 1
  ENSP ID: ENSP00000479528
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQIPPVKVVGCARVKIVTRRKRSQTAWMVSNHS

SEQ ID NO: 32844 - protein, 102 aa, Homo sapiens
  Payload ID: 6438
  Gene Symbol: FMR1
  Gene Name: fragile X mental retardation 1
  ENSP ID: ENSP00000480450
  MOD_RES (1)..(1): Any amino acid
XSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGLKI

SEQ ID NO: 32845 - protein, 76 aa, Homo sapiens
  Payload ID: 6438
  Gene Symbol: FMR1
  Gene Name: fragile X mental retardation 1
  ENSP ID: ENSP00000480513
MEELVVEVRGSNGAFYKAFVKDVHEDSITVAFENKLSPSGFCGLGDPTIPVHADNVILISIQLPTARIDHLVGSKI

SEQ ID NO: 32846 - protein, 119 aa, Homo sapiens
  Payload ID: 6438
  Gene Symbol: FMR1
  Gene Name: fragile X mental retardation 1
  ENSP ID: ENSP00000480886
DDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQKKT

SEQ ID NO: 32847 - protein, 419 aa, Homo sapiens [sequence omitted]

SEQ ID NO: 32848 - protein, 252 aa, Homo sapiens
  Payload ID: 6438
  Gene Symbol: FMR1
  Gene Name: fragile X mental retardation 1
  ENSP ID: ENSP00000481474
MEELVVEVRGSNGAFYKAFVKDVHEDSITVAFENNWQPDRQIPFHDVRFPPPVGYNKDINESDEVEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKAR

SEQ ID NO: 32849 - protein, 31 aa, Homo sapiens
  Payload ID: 6438
  Gene Symbol: FMR1
  Gene Name: fragile X mental retardation 1
  ENSP ID: ENSP00000484324
MEELVVEVRGSNGAFYKHWDFGELHCSGRGL

SEQ ID NO: 32850 - protein, 255 aa, Homo sapiens
  Payload ID: 6439
  Gene Symbol: FMR1NB
  Gene Name: fragile X mental retardation 1 neighbor
  Uniprot ID: Q8N0W7
  ENSP ID: ENSP00000359498
MSSHRRKAKGRNRRSHRAMRVAHLELATYELAATESNPESSHPGYEAAMADRPQPGWRESLKMRVSKPFGMLMLSIWILLFVCYYLSYYLCSGSSYFVLANGHILPNSENAHGQSLEEDSALEALLNFFFPTTCNLRENQVAKPCNELQDLSESECLRHKCCFSSSGTTSFKCFAPFRDVPKQMMQMFGLGAISLILVCLPIYCRSLFWRSEPADDLQRQDNRVVTGLKKQRRKRKRKSEMLQKAARGREEHGDE

SEQ ID NO: 32851 - protein, 85 aa, Homo sapiens
  Payload ID: 6439
  Gene Symbol: FMR1NB
  Gene Name: fragile X mental retardation 1 neighbor
  ENSP ID: ENSP00000435769
  MOD_RES (1)..(1): Any amino acid
XKCFAPFRDVPKQMMQMFGLGAISLILVCLPIYCRSLFWRSEPADDLQRQDNRVVTGLKKQRRKRKRKSEMLQKAARGREEHGDE

SEQ ID NO: 32852 - protein, 536 aa, Homo sapiens
  Payload ID: 6440
  Gene Symbol: FXR1
  Gene Name: fragile X mental retardation, autosomal homolog 1
  Uniprot ID: P51114
  ENSP ID: ENSP00000307633
MMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 32853 - protein, 621 aa, Homo sapiens
  Payload ID: 6440
  Gene Symbol: FXR1
  Gene Name: fragile X mental retardation, autosomal homolog 1
  Uniprot ID: P51114
  ENSP ID: ENSP00000350170
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 32854 - protein, 539 aa, Homo sapiens
  Payload ID: 6440
  Gene Symbol: FXR1
  Gene Name: fragile X mental retardation, autosomal homolog 1
  Uniprot ID: P51114
  ENSP ID: ENSP00000388828
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLGKRCD

SEQ ID NO: 32855 - protein, 75 aa, Homo sapiens
  Payload ID: 6440
  Gene Symbol: FXR1
  Gene Name: fragile X mental retardation, autosomal homolog 1
  ENSP ID: ENSP00000417125
MMKGEFYVIEYAACDATYNEIVTFERLRPVNQNKTVKKNTFFKCTVDVPEDLREACANENAHKDFKKAVGACRIF

SEQ ID NO: 32856 - protein, 151 aa, Homo sapiens
  Payload ID: 6440
  Gene Symbol: FXR1
  Gene Name: fragile X mental retardation, autosomal homolog 1
  ENSP ID: ENSP00000417513
MRAVNILVYFFGFFWWFFNVQGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAH

SEQ ID NO: 32857 - protein, 246 aa, Homo sapiens
  Payload ID: 6440
  Gene Symbol: FXR1
  Gene Name: fragile X mental retardation, autosomal homolog 1
  ENSP ID: ENSP00000418027
  MOD_RES (1)..(1): Any amino acid
XTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLDDSEKKPQRRNRSRRRRFRGQAEDRQPVTVADYISRAESQSRQRNLPRETLAKNKKEMAKDVIEEHGPSEKAINGPTSASGDDISKLQRTPGEEKINTLKEENTQEAAVLN

SEQ ID NO: 32858 - protein, 608 aa, Homo sapiens
  Payload ID: 6440
  Gene Symbol: FXR1
  Gene Name: fragile X mental retardation, autosomal homolog 1
  ENSP ID: ENSP00000418097
MVTEGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 32859 - protein, 94 aa, Homo sapiens
  Payload ID: 6440
  Gene Symbol: FXR1
  Gene Name: fragile X mental retardation, autosomal homolog 1
  ENSP ID: ENSP00000418724
MMKGEFYVIEYAACDATYNEIVTFERLRPVNQNKTVKKNTFFKCTVDVPEDLREACANENAHKDFKKAVGACRIFYHPETTQLMILSASEATVK

SEQ ID NO: 32860 - protein, 19 aa, Homo sapiens
  Payload ID: 6440
  Gene Symbol: FXR1
  Gene Name: fragile X mental retardation, autosomal homolog 1
  ENSP ID: ENSP00000419047
MAELTVEVRGSNGAFYKAI

SEQ ID NO: 32861 - protein, 119 aa, Homo sapiens
  Payload ID: 6440
  Gene Symbol: FXR1
  Gene Name: fragile X mental retardation, autosomal homolog 1
  ENSP ID: ENSP00000419793
MMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEE

SEQ ID NO: 32862 - protein, 123 aa, Homo sapiens
  Payload ID: 6440
  Gene Symbol: FXR1
  Gene Name: fragile X mental retardation, autosomal homolog 1
  ENSP ID: ENSP00000419933
MMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKH

SEQ ID NO: 32863 - protein, 454 aa, Homo sapiens
  Payload ID: 6440
  Gene Symbol: FXR1
  Gene Name: fragile X mental retardation, autosomal homolog 1
  ENSP ID: ENSP00000420515
MMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLGKRCD

SEQ ID NO: 32864 - protein, 490 aa, Homo sapiens
  Payload ID: 6440
  Gene Symbol: FXR1
  Gene Name: fragile X mental retardation, autosomal homolog 1
  ENSP ID: ENSP00000420643
MAELTVEVRGSNGAFYKVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLGKRCD

SEQ ID NO: 32865 - protein, 673 aa, Homo sapiens
  Payload ID: 6441
  Gene Symbol: FXR2
  Gene Name: fragile X mental retardation, autosomal homolog 2
  Uniprot ID: P51116
  ENSP ID: ENSP00000250113
MGGLASGGDVEPGLPVEVRGSNGAFYKGFVKDVHEDSVTIFFENNWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDLREACSNENVHKEFKKALGANCIFLNITNSELFILSTTEAPVKRASLLGDMHFRSLRTKLLLMSRNEEATKHLETSKQLAAAFQEEFTVREDLMGLAIGTHGANIQQARKVPGVTAIELGEETCTFRIYGETPEACRQARSYLEFSEDSVQVPRNLVGKVIGKNGKVIQEIVDKSGVVRVRVEGDNDKKNPREEGMVPFIFVGTRENISNAQALLEYHLSYLQEVEQLRLERLQIDEQLRQIGLGFRPPGSGRGSGGSDKAGYSTDESSSSSLHATRTYGGSYGGRGRGRRTGGPAYGPSSDVSTASETESEKREEPNRAGPGDRDPPTRGEESRRRPTGGRGRGPPPAPRPTSRYNSSSISSVLKDPDSNPYSLLDTSEPEPPVDSEPGEPPPASARRRRSRRRRTDEDRTVMDGGLESDGPNMTENGLEDESRPQRRNRSRRRRNRGNRTDGSISGDRQPVTVADYISRAESQSRQRPPLERTKPSEDSLSGQKGDSVSKLPKGPSENGELSAPLELGSMVNGVS

SEQ ID NO: 32866 - protein, 118 aa, Homo sapiens
  Payload ID: 6441
  Gene Symbol: FXR2
  Gene Name: fragile X mental retardation, autosomal homolog 2
  ENSP ID: ENSP00000459230
MSWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDLREACSNENVHKEFK

SEQ ID NO: 32867 - protein, 1335 aa, Homo sapiens
  Payload ID: 6442
  Gene Symbol: FREM1
  Gene Name: FRAS1 related extracellular matrix 1
  ENSP ID: ENSP00000370257
MNSLSWGAANAVLLLLLLAWASPTFISINRGVRVMKGHSAFLSGDDLKFAIPKEKDACKVEVVMNEPITQRVGKLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPESQLRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEVELEVYDFFFERSAPMTVHISIRTADTNAPRVSWNTGLSLLEGQSRAITWEQFQVVDNDDIGAVRLVTVGGLQHGWLTLRGGKGFLFTVADLQAGVVRYHHDDSDSTKDFVVFRIFDGHHSIRHKFPINVLPKDDSPPFLITNVVIELEEGQTILIQGSMLRASDVDASDDYIFFNITKPPQAGEIMKKPGPGLIGYPVHGFLQRDLFNGIIYYRHFGGEIFEDSFQFVLWDSHEPPNLSVPQVATIHITPVDDQLPKEAPGVSRHLVVKETEVAYITKKQLHFIDSESYDRELVYTITTPPFFSFSHRHLDAGKLFMVDSIPKVVKNPTALELRSFTQHAVNYMKVAYMPPMQDIGPHCRDVQFTFSVSNQHGGTLHGICFNITILPVDNQVPEAFTNPLKVTEGGQSIISTEHILISDADTKLDNIDLSLRELPLHGRVELNGFPLNSGGTFSWGDLHTLKVRYQHDGTEVLQDDLLLEVTDGTNSAEFVLHVEVFPVNDEPPVLKADLMPVMNCSEGGEVVITSEYIFATDVDSDNLKLMFVIAREPQHGVVRRAGVTVDQFSQRDVISEAVTYKHTGGEIGLMPCFDTITLVVSDGEAGPFVNGCCYNGPNPSVPLHASFPVYDLNITVYPVDNQPPSIAIGPVFVVDEGCSTALTVNHLSATDPDTAADDLEFVLVSPPQFGYLENILPSVGFEKSNIGISIDSFQWKDMNAFHINYVQSRHLRIEPTADQFTVYVTDGKHHSLEIPFSIIINPTNDEAPDFVVQNITVCEGQMKELDSSIISAVDLDIPQDALLFSITQKPRHGLLIDRGFSKDFSENKQPANPHQKHAPVHSFSMELLKTGMRLTYMHDDSESLADDFTIQLSDGKHKILKTISVEVIPVNDEKPMLSKKAEIAMNMGETRIISSAILSAIDEDSPREKIYYVFERLPQNGQLQLKECQLRCGI

SEQ ID NO: 32868 - protein, 2179 aa, Homo sapiens
  Payload ID: 6442
  Gene Symbol: FREM1
  Gene Name: FRAS1 related extracellular matrix 1
  Uniprot ID: Q5H8C1
  ENSP ID: ENSP00000370262
MNSLSWGAANAVLLLLLLAWASPTFISINRGVRVMKGHSAFLSGDDLKFAIPKEKDACKVEVVMNEPITQRVGKLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPESQLRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEVELEVYDFFFERSAPMTVHISIRTADTNAPRVSWNTGLSLLEGQSRAITWEQFQVVDNDDIGAVRLVTVGGLQHGWLTLRGGKGFLFTVADLQAGVVRYHHDDSDSTKDFVVFRIFDGHHSIRHKFPINVLPKDDSPPFLITNVVIELEEGQTILIQGSMLRASDVDASDDYIFFNITKPPQAGEIMKKPGPGLIGYPVHGFLQRDLFNGIIYYRHFGGEIFEDSFQFVLWDSHEPPNLSVPQVATIHITPVDDQLPKEAPGVSRHLVVKETEVAYITKKQLHFIDSESYDRELVYTITTPPFFSFSHRHLDAGKLFMVDSIPKVVKNPTALELRSFTQHAVNYMKVAYMPPMQDIGPHCRDVQFTFSVSNQHGGTLHGICFNITILPVDNQVPEAFTNPLKVTEGGQSIISTEHILISDADTKLDNIDLSLRELPLHGRVELNGFPLNSGGTFSWGDLHTLKVRYQHDGTEVLQDDLLLEVTDGTNSAEFVLHVEVFPVNDEPPVLKADLMPVMNCSEGGEVVITSEYIFATDVDSDNLKLMFVIAREPQHGVVRRAGVTVDQFSQRDVISEAVTYKHTGGEIGLMPCFDTITLVVSDGEAGPFVNGCCYNGPNPSVPLHASFPVYDLNITVYPVDNQPPSIAIGPVFVVDEGCSTALTVNHLSATDPDTAADDLEFVLVSPPQFGYLENILPSVGFEKSNIGISIDSFQWKDMNAFHINYVQSRHLRIEPTADQFTVYVTDGKHHSLEIPFSIIINPTNDEAPDFVVQNITVCEGQMKELDSSIISAVDLDIPQDALLFSITQKPRHGLLIDRGFSKDFSENKQPANPHQKHAPVHSFSMELLKTGMRLTYMHDDSESLADDFTIQLSDGKHKILKTISVEVIPVNDEKPMLSKKAEIAMNMGETRIISSAILSAIDEDSPREKIYYVFERLPQNGQLQLKIGRDWVPLSPGMKCTQEEVDLNLLRYTHTGAMDSQNQDSFTFYLWDGNNRSPALDCQITIKDMEKGDIVILTKPLVVSKGDRGFLTTTTLLAVDGTDKPEELLYVITSPPRYGQIEYVHYPGVPITNFSQMDVVGQTVCYVHKSKVTVSSDRFRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 32869 - protein, 715 aa, Homo sapiens
  Payload ID: 6442
  Gene Symbol: FREM1
  Gene Name: FRAS1 related extracellular matrix 1
  Uniprot ID: Q5H8C1
  ENSP ID: ENSP00000370278
MVTQESMLKAALPLFTRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 32870 - protein, 222 aa, Homo sapiens
  Payload ID: 6442
  Gene Symbol: FREM1
  Gene Name: FRAS1 related extracellular matrix 1
  Uniprot ID: Q5H8C1
  ENSP ID: ENSP00000412597
MLDESLAVRRSKKCKEMIMHWEKKEDIDIVNTVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGSSILCL

SEQ ID NO: 32871 - protein, 2179 aa, Homo sapiens; identical to SEQ ID NO: 32868
  Payload ID: 6442
  Gene Symbol: FREM1
  Gene Name: FRAS1 related extracellular matrix 1
  Uniprot ID: Q5H8C1
  ENSP ID: ENSP00000412940

SEQ ID NO: 32872 - protein, 2139 aa, Homo sapiens
  Payload ID: 6443
  Gene Symbol: FREM3
  Gene Name: FRAS1 related extracellular matrix 3
  Uniprot ID: P0C091
  ENSP ID: ENSP00000332886
MAGASRHPTGTPRQLLVALACLLLSRPALQGRASSLGTEPDPALYLPARGALDGTRPDGPSVLIANPGLRVPLGRSLWLDPLRDLVIGVQPGDRCEVTVLDALPRLKGALSPRRFPCTFGPRQVQYTHFGSHSPGRARVLLQLRYDAPTHTLVLPFTLAVDLVFSQLELVTRNRPLVVEKLRSWSRAIDRRVLDFASLKSGATATRRCRLTPLPHEDGPLPKYGRLVDAVGAPLPRGKGVDCEAFLRAGVRYQHTATSSPNRDYVPMMVELLGPEGQDAGSAGVLVREHFQLLVRIRGGAENTPPRPSFMATMMMEVDPLVLTALTPDALAAEDVESDPGDLVFNILNAPTHPPGHPGQQGYVVSTDDPLGLPVSFFTQQELRELKIAYQPPAENSHGERLFQLELEVVDGDGAASDPFAFMVTVKSMNTLVPVASHNRGLVLFEGQSRPLSSTHSIPISDKDNLEEVKMAAVRGLRHGQLVVFGAPAGCKYFTPADLAAGRVVYQHDGSNTYSDNIIFRMEDGHHQVDFLFPLTILPVDDEPPMVNTNTGLSLTEGQVVQISPFVLSATDIDSEDSTIHFVLENQPLKGNEEEPQWELAPGSSHSGHYLGDLLLQQAELPLSTEDEDWHYMEKEGLYEKVVTEWLQRDIMEGRLFYRHLGPHSPQSVMVQLAFHVQDDHDPPNLSKQHIFTIKVQPVDILSPQLYPGTTLEMTVQEYQLTHFQKNFLRYIDQDSDDQNLWYTLLTLPTDTDGNHQVRAGEIVLTDSPDTLIMHFTQAQVNQHKVAYQPPQKLGIAPRVVQFTYQVEDAAGNSVPGTFTLFLQPVDNQPPEVTNRGFAILEGGSFNLSSNELHVTDPDTDIDQIVFILVRGPQHGHLQYFKRCMVPGESFMQADVINGSVSYQHGRDQTTTSDTFHLEVSDGVHHIPITIPISVHPNVANRSPRISLRSSSLLDVSIDVLENKATEITMGVIHGKRKDVGDLMLSFIVKDSPKLGTILVNGLPTERFTQEDLINGRVAYAHTAGEVGFQKQHDAFSLILSKDSYQWVVGNSIIEKVQVQVTVLPVDNVGPKVFVGESFIVYEGEKNSLTLQHLHVEDVDTHQDELLCTVTSQPASGYLEKIASAPGSKMSQSGSPISAFSLRDIQVRHINYVQSIHKGVEPQEDQFTFYCSDGINFSPNVFFPIIILPTNDEQPKLFAHEFKVLEGMSLVIDTQLLNGADADLPPNELHFQLTALPRHGRIIQQLATGSQPIHSFTLKEIQEASTIVYEHDDSETKEDSFEVWLSDGKHTTHRKVPIVVTLVDDETPHLTVNNGLKVEKGHSEIITNRILKATDLDSDDKSLSFVLHSGPQQGLLQRLRKPRGEVRNNLTLGMNFTQDEINRGLICYIHTGQEGIVDIIKFDVTDGVNTLTDHYFYVTIGNLDSVFPEVISKRITLIEGARVTLTNNLLTNSDINSSDEHHFSITRAPSLGHLESSDYAGEPIASFTQLQLASNKISYVHTSNDEKKMDSFEFQVIGELYPVFRTFRIFITDVDNKKPILTIHRLTLQKEDSQLITLLELTVEDSDTPDDLILFTITQVPMHGKILYNGSRPVTTFTKQDLNKNLISYKHDGSETTEDSFSLTVTDGTHTDFYVLPDTALATHKPQVMRVQIRSLDNRLPQITTNRGAPALKRLHTGHMGFLITSKSLKAEDQDSPHRLLKYKVTRGPEHGFIIKTGLGNQSTRVFTQADIDEMKISYVLNEGSNASKDIFYFSVEDNGGNKLTNQPFHLNWAWICLEKEYYIVDEDSTFLEVTLTRRGYLGETSFISIGTKDETAKKDKDFKWKTNKQIQFNPGQTTATWRVRIIPDNEYETSETFQIILSEPLMAVLEFPEMATVEIVDPGDESTVYIPEAEYKIEEDIGELLIPVRRSGDASQELIVICSTRQGSATGTISSTVLFSDYISRPEDHTSILHFDKNETQKTCQVLIIDDSLYEEEESFSVSLRLPVGGQLGARFPTTKVTILADRYDEPVLHFGDAEYHVNESARYVEVCVWRRGTDLSQPSSIAVRSRKSEQESAEAGTDYVGISRNLDFAPGVRMQTFQVTILDDLGQPTLEGPEKFELLLQMPMGAVLGEPNKTTIFIEDTITDCKQSACSSFD

SEQ ID NO: 32873 - protein, 3169 aa, Homo sapiens
  Payload ID: 6444
  Gene Symbol: FREM2
  Gene Name: FRAS1 related extracellular matrix protein 2
  Uniprot ID: Q5SZK8
  ENSP ID: ENSP00000280481
MHSAGTPGLSSRRTGNSTSFQPGPPPPPRLLLLLLLLLSLVSRVPAQPAAFGRALLSPGLAGAAGVPAEEAIVLANRGLRVPFGREVWLDPLHDLVLQVQPGDRCAVSVLDNDALAQRPGRLSPKRFPCDFGPGEVRYSHLGARSPSRDRVRLQLRYDAPGGAVVLPLVLEVEVVFTQLEVVTRNLPLVVEELLGTSNALDARSLEFAFQPETEECRVGILSGLGALPRYGELLHYPQVPGGAREGGAPETLLMDCKAFQELGVRYRHTAASRSPNRDWIPMVVELRSRGAPVGSPALKREHFQVLVRIRGGAENTAPKPSFVAMMMMEVDQFVLTALTPDMLAAEDAESPSDLLIFNLTSPFQPGQGYLVSTDDRSLPLSSFTQRDLRLLKIAYQPPSEDSDQERLFELELEVVDLEGAASDPFAFMVVVKPMNTMAPVVTRNTGLILYEGQSRPLTGPAGSGPQNLVISDEDDLEAVRLEVVAGLRHGHLVILGASSGSSAPKSFTVAELAAGQVVYQHDDRDGSLSDNLVLRMVDGGGRHQVQFLFPITLVPVDDQPPVLNANTGLTLAEGETVPILPLSLSATDMDSDDSLLLFVLESPFLTTGHLLLRQTHPPHEKQELLRGLWRKEGAFYERTVTEWQQQDITEGRLFYRHSGPHSPGPVTDQFTFRVQDNHDPPNQSGLQRFVIRIHPVDRLPPELGSGCPLRMVVQESQLTPLRKKWLRYTDLDTDDRELRYTVTQPPTDTDENHLPAPLGTLVLTDNPSVVVTHFTQAQINHHKIAYRPPGQELGVATRVAQFQFQVEDRAGNVAPGTFTLYLHPVDNQPPEILNTGFTIQEKGHHILSETELHVNDVDTDVAHISFTLTQAPKHGHMRVSGQILHVGGLFHLEDIKQGRVSYAHNGDKSLTDSCSLEVSDRHHVVPITLRVNVRPVDDEVPILSHPTGTLESYLDVLENGATEITANVIKGTNEETDDLMLTFLLEDPPLYGEILVNGIPAEQFTQRDILEGSVVYTHTSGEIGLLPKADSFNLSLSDMSQEWRIGGNTIQGVTIWVTILPVDSQAPEIFVGEQLIVMEGDKSVITSVHISAEDVDSLNDDILCTIVIQPTSGYVENISPAPGSEKSRAGIAISAFNLKDLRQGHINYVQSVHKGVEPVEDRFVFRCSDGINFSERQFFPIVIIPTNDEQPEMFMREFMVMEGMSLVIDTPILNAADADVPLDDLTFTITQFPTHGHIMNQLINGTVLVESFTLDQIIESSSIIYEHDDSETQEDSFVIKLTDGKHSVEKTVLIIVIPVDDETPRMTINNGLEIEIGDTKIINNKILMATDLDSEDKSLVYIIRYGPGHGLLQRRKPTGAFENITLGMNFTQDEVDRNLIQYVHLGQEGIRDLIKFDVTDGINPLIDRYFYVSIGSIDIVFPDVISKGVSLKEGGKVTLTTDLLSTSDLNSPDENLVFTITRAPMRGHLECTDQPGVSITSFTQLQLAGNKIYYIHTADDEVKMDSFEFQVTDGRNPVFRTFRISISDVDNKKPVVTIHKLVVSESENKLITPFELTVEDRDTPDKLLKFTITQVPIHGHLLFNNTRPVMVFTKQDLNENLISYKHDGTESSEDSFSFTVTDGTHTDFYVFPDTVFETRRPQVMKIQVLAVDNSVPQIAVNKGASTLRTLATGHLGFMITSKILKVEDRDSLHISLRFIVTEAPQHGYLLNLDKGNHSITQFTQADIDDMKICYVLREGANATSDMFYFAVEDGGGNKLTYQNFRLNWAWISFEKEYYLVNEDSKFLDVVLKRRGYLGETSFISIGTRDRTAEKDKDFKGKAQKQVQFNPGQTRATWRVRILSDGEHEQSETFQVVLSEPVLAALEFPTVATVEIVDPGDEPTVFIPQSKYSVEEDVGELFIPIRRSGDVSQELMVVCYTQQGTATGTVPTSVLSYSDYISRPEDHTSVVRFDKDEREKLCRIVIIDDSLYEEEETFHVLLSMPMGGRIGSEFPGAQVTIVPDKDDEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDLPKMQFKERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVLNLVQSYVTLRVPLYVSYVFHSPVGVGGWQHFDLKSELRLTFVYDTAILWNDGIGSPPEAELQGSLYPTSMRIGDEGRLAVHFKTEAQFHGLFVLSHPASFTSSVIMSADHPGLTFSLRLIRSEPTYNQPVQQWSFVSDFAVRDYSGTYTVKLVPCTAPSHQEYRLPVTCNPREPVTFDLDIRFQQVSDPVAAEFSLNTQMYLLSKKSLWLSDGSMGFGQESDVAFAEGDIIYGRVMVDPVQNLGDSFYCSIEKVFLCTGADGYVPKYSPMNAEYGCLADSPSLLYRFKIVDKAQPETQATSFGNVLFNAKLAVDDPEAILLVNQPGSDGFKVDSTPLFQVALGREWYIHTIYTVRSKDNANRGIGKRSVEYHSLVSQGKPQSTTKSRKKREIRSTPSLAWEIGAENSRGTNIQHIALDRTKRQIPHGRAPPDGILPWELNSPSSAVSLVTVVGGTTVGLLTICLTVIAVLMCRGKESFRGKDAPKGSSSSEPMVPPQSHHNDSSEV

SEQ ID NO: 32874 - protein, 317 aa, Homo sapiens
  Payload ID: 6445
  Gene Symbol: FRAS1
  Gene Name: Fraser extracellular matrix complex subunit 1
  ENSP ID: ENSP00000264899
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPALASQSVGITGMSHHAQSLLGPFLTQIKKPHFSCLE

SEQ ID NO: 32875 - protein, 1976 aa, Homo sapiens
  Payload ID: 6445
  Gene Symbol: FRAS1
  Gene Name: Fraser extracellular matrix complex subunit 1
  Uniprot ID: Q86XX4
  ENSP ID: ENSP00000326330
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIEVKTLEVGKVEPLTTIFHTIRELSL

SEQ ID NO: 32876 - protein, 426 aa, Homo sapiens
  Payload ID: 6445
  Gene Symbol: FRAS1
  Gene Name: Fraser extracellular matrix complex subunit 1
  ENSP ID: ENSP00000422221
  MOD_RES (1)..(1): Any amino acid
XTLPLHPNQGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIEVKTLEVGKVEPLTTIFHTIRELSL

SEQ ID NO: 32877 - protein, 4012 aa, Homo sapiens
  Payload ID: 6445
  Gene Symbol: FRAS1
  Gene Name: Fraser extracellular matrix complex subunit 1
  Uniprot ID: Q86XX4
  ENSP ID: ENSP00000422834
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIERKNDEPPRMTLQPLRVQLSSGVVISNSSLSLQDLDTPDNELIFVLTKKPDHGHVLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGHVEYSHGTGEPGGSFAFKFDVVDGEGNRLIDKSFSISILEDKSPPVITTNKGLVLDENSVKKITTLQLSATDQDSGPTELIYRITRQPQLGHLEHAASPGIQISSFTQADLTSRNVQYVHSSEAEKHSDAFSFTLSDGVSEVTQTFHITLHPVDDSLPVVQNLGMRVQEGMRKTITEFELKAVDADTEAESVTFTIVQPPRHGTIERTSNGQHFHLTSTFTMKDIYQNRVSYSHDGSNSLKDRFTFTVSDGTNPFFIIEEGGKEIMTAAPQPFRVDILPVDDGTPRIVTNLGLQWLEYMDGKATNLITKKELLTMDPDTEDAQLVYEITTGPKHGFVENKLQPGRAAATFTQEDVNLGLIRYVLHKEKIREMMDSFQFLVKDSKPNVVSDNVFHIQWSLISFKYTSYNVSEKAGSVSVTVQRTGNLNQYAIVLCRTEQGTASSSSRVSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAICYTVPKSAMGSSLYALESGSDFKSRGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGISEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTNRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGASIGSALAAIMLLLLVFLVACFINRKCQKQRKKKPAEDILEEYPLNTKVEVPKRHPDRVEKNVNRHYCTVRNVNILSEPEAAYTFKGAKVKRLNLEVRVHNNLQDGTEV

SEQ ID NO: 32878 - protein, 666 aa, Homo sapiens
  Payload ID: 6445
  Gene Symbol: FRAS1
  Gene Name: Fraser extracellular matrix complex subunit 1
  ENSP ID: ENSP00000423645
  MOD_RES (1)..(1): Any amino acid
XGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEGQNLDFCQNLEVISAVCLGISSTEN

SEQ ID NO: 32879 - protein, 652 aa, Homo sapiens
  Payload ID: 6445
  Gene Symbol: FRAS1
  Gene Name: Fraser extracellular matrix complex subunit 1
  ENSP ID: ENSP00000423809
  MOD_RES (1)..(1): Any amino acid
XCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCAGE

SEQ ID NO: 32880 - protein, 39 aa, Homo sapiens
  Payload ID: 6445
  Gene Symbol: FRAS1
  Gene Name: Fraser extracellular matrix complex subunit 1
  ENSP ID: ENSP00000425583
MGVLKVWLGLALALAEFAVLPHHSEGACVYQDSLLAEGG

SEQ ID NO: 32881 - protein, 210 aa, Homo sapiens
  Payload ID: 6446
  Gene Symbol: FXN
  Gene Name: frataxin
  Uniprot ID: Q16595
  ENSP ID: ENSP00000366482
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSSGPKRYDWTGKNWVYSHDGVSLHELLAAELTKALKTKLDLSSLAYSGKDA

SEQ ID NO: 32882 - protein, 171 aa, Homo sapiens
  Payload ID: 6446
  Gene Symbol: FXN
  Gene Name: frataxin
  Uniprot ID: Q16595
  ENSP ID: ENSP00000379650
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSRLTWLLWLFHP

SEQ ID NO: 32883 - protein, 196 aa, Homo sapiens
  Payload ID: 6446
  Gene Symbol: FXN
  Gene Name: frataxin
  Uniprot ID: Q16595
  ENSP ID: ENSP00000379652
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSRYVVDLSVMTGLGKTGCTPTTACPSMSCWPQSSLKP

SEQ ID NO: 32884 - protein, 135 aa, Homo sapiens
  Payload ID: 6446
  Gene Symbol: FXN
  Gene Name: frataxin
  ENSP ID: ENSP00000418015
MNLRKSGTLGHPGSLDETTYERLAEETLDSLAEFFEDLADKPYTFEDYDVSFGSGVLTVKLGGDLGTYVINKQTPNKQIWLSSPSSGPKRYDWTGKNWVYSHDGVSLHELLAAELTKALKTKLDLSSLAYSGKDA

SEQ ID NO: 32885 - protein, 108 aa, Homo sapiens
  Payload ID: 6446
  Gene Symbol: FXN
  Gene Name: frataxin
  ENSP ID: ENSP00000419243
  MOD_RES (1)..(1): Any amino acid
XPDLECQKAECLFDEFEEIWNFGPPRSGVLTVKLGGDLGTYVINKQTPNKQIWLSSPSSGPKRYDWTGKNWVYSHDGVSLHELLAAELTKALKTKLDLSSLAYSGKDA

SEQ ID NO: 32886 - protein, 300 aa, Homo sapiens
  Payload ID: 6447
  Gene Symbol: FFAR1
  Gene Name: free fatty acid receptor 1
  Uniprot ID: O14842
  ENSP ID: ENSP00000246553
MDLPPQLSFGLYVAAFALGFPLNVLAIRGATAHARLRLTPSLVYALNLGCSDLLLTVSLPLKAVEALASGAWPLPASLCPVFAVAHFFPLYAGGGFLAALSAGRYLGAAFPLGYQAFRRPCYSWGVCAAIWALVLCHLGLVFGLEAPGGWLDHSNTSLGINTPVNGSPVCLEAWDPASAGPARFSLSLLLFFLPLAITAFCYVGCLRALARSGLTHRRKLRAAWVAGGALLTLLLCVGPYNASNVASFLYPNLGGSWRKLGLITGAWSVVLNPLVTGYLGRGPGLKTVCAARTQGGKSQK

SEQ ID NO: 32887 - protein, 330 aa, Homo sapiens
  Payload ID: 6448
  Gene Symbol: FFAR2
  Gene Name: free fatty acid receptor 2
  Uniprot ID: O15552
  ENSP ID: ENSP00000246549
MLPDWKSSLILMAYIIIFLTGLPANLLALRAFVGRIRQPQPAPVHILLLSLTLADLLLLLLLPFKIIEAASNFRWYLPKVVCALTSFGFYSSIYCSTWLLAGISIERYLGVAFPVQYKLSRRPLYGVIAALVAWVMSFGHCTIVIIVQYLNTTEQVRSGNEITCYENFTDNQLDVVLPVRLELCLVLFFIPMAVTIFCYWRFVWIMLSQPLVGAQRRRRAVGLAVVTLLNFLVCFGPYNVSHLVGYHQRKSPWWRSIAVVFSSLNASLDPLLFYFSSSVVRRAFGRGLQVLRNQGSSLLGRRGKDTAEGTNEDRGVGQGEGMPSSDFTTE

SEQ ID NO: 32888 - protein, 330 aa, Homo sapiens; identical to SEQ ID NO: 32887
  Payload ID: 6448
  Gene Symbol: FFAR2
  Gene Name: free fatty acid receptor 2
  Uniprot ID: O15552
  ENSP ID: ENSP00000473159

SEQ ID NO: 32889 - protein, 346 aa, Homo sapiens
  Payload ID: 6449
  Gene Symbol: FFAR3
  Gene Name: free fatty acid receptor 3
  Uniprot ID: O14843
  ENSP ID: ENSP00000328230
MDTGPDQSYFSGNHWFVFSVYLLTFLVGLPLNLLALVVFVGKLQRRPVAVDVLLLNLTASDLLLLLFLPFRMVEAANGMHWPLPFILCPLSGFIFFTTIYLTALFLAAVSIERFLSVAHPLWYKTRPRLGQAGLVSVACWLLASAHCSVVYVIEFSGDISHSQGTNGTCYLEFRKDQLAILLPVRLEMAVVLFVVPLIITSYCYSRLVWILGRGGSHRRQRRVAGLLAATLLNFLVCFGPYNVSHVVGYICGESPAWRIYVTLLSTLNSCVDPFVYYFSSSGFQADFHELLRRLCGLWGQWQQESSMELKEQKGGEEQRADRPAERKTSEHSQGCGTGGQVACAES

SEQ ID NO: 32890 - protein, 346 aa, Homo sapiens; identical to SEQ ID NO: 32889
  Payload ID: 6449
  Gene Symbol: FFAR3
  Gene Name: free fatty acid receptor 3
  Uniprot ID: O14843
  ENSP ID: ENSP00000469522

SEQ ID NO: 32891 - protein, 361 aa, Homo sapiens [sequence omitted]

SEQ ID NO: 32892 - protein, 377 aa, Homo sapiens
  Payload ID: 6450
  Gene Symbol: FFAR4
  Gene Name: free fatty acid receptor 4
  Uniprot ID: Q5NUL3
  ENSP ID: ENSP00000360538
MSPECARAAGDAPLRSLEQANRTRFPFFSDVKGDHRLVLAAVETTVLVLIFAVSLLGNVCALVLVARRRRRGATACLVLNLFCADLLFISAIPLVLAVRWTEAWLLGPVACHLLFYVMTLSGSVTILTLAAVSLERMVCIVHLQRGVRGPGRRARAVLLALIWGYSAVAALPLCVFFRVVPQRLPGADQEISICTLIWPTIPGEISWDVSFVTLNFLVPGLVIVISYSKILQTSEHLLDARAVVTHSEITKASRKRLTVSLAYSESHQIRVSQQDFRLFRTLFLLMVSFFIMWSPIIITILLILIQNFKQDLVIWPSLFFWVVAFTFANSALNPILYNMTLCRNEWKKIFCCFWFPEKGAILTDTSVKRNDLSIISG

SEQ ID NO: 32893 - protein, 236 aa, Homo sapiens
  Payload ID: 6450
  Gene Symbol: FFAR4
  Gene Name: free fatty acid receptor 4
  ENSP ID: ENSP00000474477
MSPECARAAGDAPLRSLEQANRTRFPFFSDVKGDHRLVLAAVETTVLVLIFAVSLLGNVCALVLVARRRRRGATACLVLNLFCADLLFISAIPLVLAVRWTEAWLLGPVACHLLFYVMTLSGSVTILTLAAVSLERMVCIVHLQRGVRGPGRRARAVLLALIWGYSAVAALPLCVFFRVVPQRLPGADQEISICTLIWPTIPGEISWDVSFVTLNFLVPGLVIVISYSKILQGPHW

SEQ ID NO: 32894 - protein, 279 aa, Homo sapiens
  Payload ID: 6451
  Gene Symbol: FRAT1
  Gene Name: frequently rearranged in advanced T-cell lymphomas 1
  Uniprot ID: Q92837
  ENSP ID: ENSP00000360060
MPCRREEEEEAGEEAEGEEEEEDSFLLLQQSVALGSSGEVDRLVAQIGETLQLDAAQHSPASPCGPPGAPLRAPGPLAAAVPADKARSPAVPLLLPPALAETVGPAPPGVLRCALGDRGRVRGRAAPYCVAELATGPSALSPLPPQADLDGPPGAGKQGIPQPLSGPCRRGWLRGAAASRRLQQRRGSQPETRTGDDDPHRLLQQLVLSGNLIKEAVRRLHSRRLQLRAKLPQRPLLGPLSAPVHEPPSPRSPRAACSDPGASGRAQLRTGDGVLVPGS

SEQ ID NO: 32895 - protein, 233 aa, Homo sapiens
  Payload ID: 6452
  Gene Symbol: FRAT2
  Gene Name: frequently rearranged in advanced T-cell lymphomas 2
  Uniprot ID: O75474
  ENSP ID: ENSP00000360058
MPCRREEEEEAGEEAEGEEEEDDSFLLLQQSVTLGSSGEVDRLVAQIGETLQLDAAQDSPASPCAPPGVPLRAPGPLAAAVPADKARPPAVPLLLPPASAETVGPAPSGALRCALGDRGRVRGRAAPYCVAEVAAGPSALPGPCRRGWLRDAVTSRRLQQRRWTQAGARAGDDDPHRLLQQLVLSGNLIKEAVRRLQRAVAAVAATGPASAPGPGGGRSGPDRIALQPSGSLL

SEQ ID NO: 32896 - protein, 647 aa, Homo sapiens
  Payload ID: 6453
  Gene Symbol: FZD1
  Gene Name: frizzled class receptor 1
  Uniprot ID: Q9UP38
  ENSP ID: ENSP00000287934
MAEEEAPKKSRAAGGGASWELCAGALSARLAEEGSGDAGGRRRPPVDPRRLARQLLLLLWLLEAPLLLGVRAQAAGQGPGQGPGPGQQPPPPPQQQQSGQQYNGERGISVPDHGYCQPISIPLCTDIAYNQTIMPNLLGHTNQEDAGLEVHQFYPLVKVQCSAELKFFLCSMYAPVCTVLEQALPPCRSLCERARQGCEALMNKFGFQWPDTLKCEKFPVHGAGELCVGQNTSDKGTPTPSLLPEFWTSNPQHGGGGHRGGFPGGAGASERGKFSCPRALKVPSYLNYHFLGEKDCGAPCEPTKVYGLMYFGPEELRFSRTWIGIWSVLCCASTLFTVLTYLVDMRRFSYPERPIIFLSGCYTAVAVAYIAGFLLEDRVVCNDKFAEDGARTVAQGTKKEGCTILFMMLYFFSMASSIWWVILSLTWFLAAGMKWGHEAIEANSQYFHLAAWAVPAIKTITILALGQVDGDVLSGVCFVGLNNVDALRGFVLAPLFVYLFIGTSFLLAGFVSLFRIRTIMKHDGTKTEKLEKLMVRIGVFSVLYTVPATIVIACYFYEQAFRDQWERSWVAQSCKSYAIPCPHLQAGGGAPPHPPMSPDFTVFMIKYLMTLIVGITSGFWIWSGKTLNSWRKFYTRLTNSKQGETTV

SEQ ID NO: 32897 - protein, 581 aa, Homo sapiens
  Payload ID: 6454
  Gene Symbol: FZD10
  Gene Name: frizzled class receptor 10
  Uniprot ID: Q9ULW2
  ENSP ID: ENSP00000229030
MQRPGPRLWLVLQVMGSCAAISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKRFAVVWLAIWAVLCFFSSAFTVLTFLIDPARFRYPERPIIFLSMCYCVYSVGYLIRLFAGAESIACDRDSGQLYVIQEGLESTGCTLVFLVLYYFGMASSLWWVVLTLTWFLAAGKKWGHEAIEANSSYFHLAAWAIPAVKTILILVMRRVAGDELTGVCYVGSMDVNALTGFVLIPLACYLVIGTSFILSGFVALFHIRRVMKTGGENTDKLEKLMVRIGLFSVLYTVPATCVIACYFYERLNMDYWKILAAQHKCKMNNQTKTLDCLMAASIPAVEIFMVKIFMLLVVGITSGMWIWTSKTLQSWQQVCSRRLKKKSRRKPASVITSGGIYKKAQHPQKTHHGKYEIPAQSPTCV

SEQ ID NO: 32898 - protein, 454 aa, Homo sapiens
  Payload ID: 6454
  Gene Symbol: FZD10
  Gene Name: frizzled class receptor 10
  ENSP ID: ENSP00000438460
MPAHRDPDVQGHRLQHDSYAQPDGPREPARGSHPVARVRAAGGVRLPRPPPLLPVLAVRADVHRAGLYPHPRLPGHVRAGPAQVLPDYGAVQLQVARLPGLPETPQQERPQLPVHGGAQQRLGRAHPGLGPVPAAVPAAAAPQRAGAPAEGRGPRARRLRQPGQVPPRGEERVVRAALHARRGRVLEPRGQALRSGLAGHLGGAVLLLQRLHRAHLPHRPGPLPLPRAPHHLPLHVLLRLLRGLPHPPLRRRREHRLRPGQRPALCHPGGTGEHRLHAGLPGPLLLRHGQLAVVGGPHAHLVPGRRQEVGPRGHRSQQQLLPPGSLGHPGGEDHPDPGHAQGGGGRAHRGLLRGQHGRQRAHRLRAHSPGLLPGHRHVLHPLGLRGPVPHPEGDEDGRREHGQAGEAHGAYRALLCAVHRAGHLCDRLLLLRTPQHGLLEDPGGAAQVQNEQPD

SEQ ID NO: 32899 - protein, 565 aa, Homo sapiens
  Payload ID: 6455
  Gene Symbol: FZD2
  Gene Name: frizzled class receptor 2
  Uniprot ID: Q14332
  ENSP ID: ENSP00000323901
MRPRSALPRLLLPLLLLPAAGPAQFHGEKGISIPDHGFCQPISIPLCTDIAYNQTIMPNLLGHTNQEDAGLEVHQFYPLVKVQCSPELRFFLCSMYAPVCTVLEQAIPPCRSICERARQGCEALMNKFGFQWPERLRCEHFPRHGAEQICVGQNHSEDGAPALLTTAPPPGLQPGAGGTPGGPGGGGAPPRYATLEHPFHCPRVLKVPSYLSYKFLGERDCAAPCEPARPDGSMFFSQEETRFARLWILTWSVLCCASTFFTVTTYLVDMQRFRYPERPIIFLSGCYTMVSVAYIAGFVLQERVVCNERFSEDGYRTVVQGTKKEGCTILFMMLYFFSMASSIWWVILSLTWFLAAGMKWGHEAIEANSQYFHLAAWAVPAVKTITILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 32900 - protein, 666 aa, Homo sapiens
  Payload ID: 6456
  Gene Symbol: FZD3
  Gene Name: frizzled class receptor 3
  Uniprot ID: Q9NPG1
  ENSP ID: ENSP00000240093
MAMTWIVFSLWPLTVFMGHIGGHSLFSCEPITLRMCQDLPYNTTFMPNLLNHYDQQTAALAMEPFHPMVNLDCSRDFRPFLCALYAPICMEYGRVTLPCRRLCQRAYSECSKLMEMFGVPWPEDMECSRFPDCDEPYPRLVDLNLAGEPTEGAPVAVQRDYGFWCPRELKIDPDLGYSFLHVRDCSPPCPNMYFRREELSFARYFIGLISIICLSATLFTFLTFLIDVTRFRYPERPIIFYAVCYMMVSLIFFIGFLLEDRVACNASIPAQYKASTVTQGSHNKACTMLFMILYFFTMAGSVWWVILTITWFLAAVPKWGSEAIEKKALLFHASAWGIPGTLTIILLAMNKIEGDNISGVCFVGLYDVDALRYFVLAPLCLYVVVGVSLLLAGIISLNRVRIEIPLEKENQDKLVKFMIRIGVFSILYLVPLLVVIGCYFYEQAYRGIWETTWIQERCREYHIPCPYQVTQMSRPDLILFLMKYLMALIVGIPSVFWVGSKKTCFEWASFFHGRRKKEIVNESRQVLQEPDFAQSLLRDPNTPIIRKSRGTSTQGTSTHASSTQLAMVDDQRSKAGSIHSKVSSYHGSLHRSRDGRYTPCSYRGMEERLPHGSMSRLTDHSRHSSSHRLNEQSRHSSIRDLSNNPMTHITHGTSMNRVIEEDGTSA

SEQ ID NO: 32901 - protein, 35 aa, Homo sapiens
  Payload ID: 6456
  Gene Symbol: FZD3
  Gene Name: frizzled class receptor 3
  ENSP ID: ENSP00000430125
MAMTWIVFSLWPLTVFMGHIGGHSLFSCEPITLRM

SEQ ID NO: 32902 - protein, 666 aa, Homo sapiens; identical to SEQ ID NO: 32900
  Payload ID: 6456
  Gene Symbol: FZD3
  Gene Name: frizzled class receptor 3
  Uniprot ID: Q9NPG1
  ENSP ID: ENSP00000437489

SEQ ID NO: 32903 - protein, 537 aa, Homo sapiens
  Payload ID: 6457
  Gene Symbol: FZD4
  Gene Name: frizzled class receptor 4
  Uniprot ID: Q9ULV1
  ENSP ID: ENSP00000434034
MAWRGAGPSVPGAPGGVGLSLGLLLQLLLLLGPARGFGDEEERRCDPIRISMCQNLGYNVTKMPNLVGHELQTDAELQLTTFTPLIQYGCSSQLQFFLCSVYVPMCTEKINIPIGPCGGMCLSVKRRCEPVLKEFGFAWPESLNCSKFPPQNDHNHMCMEGPGDEEVPLPHKTPIQPGEECHSVGTNSDQYIWVKRSLNCVLKCGYDAGLYSRSAKEFTDIWMAVWASLCFISTAFTVLTFLIDSSRFSYPERPIIFLSMCYNIYSIAYIVRLTVGRERISCDFEEAAEPVLIQEGLKNTGCAIIFLLMYFFGMASSIWWVILTLTWFLAAGLKWGHEAIEMHSSYFHIAAWAIPAVKTIVILIMRLVDADELTGLCYVGNQNLDALTGFVVAPLFTYLVIGTLFIAAGLVALFKIRSNLQKDGTKTDKLERLMVKIGVFSVLYTVPATCVIACYFYEISNWALFRYSADDSNMAVEMLKIFMSLLVGITSGMWIWSAKTLHTWQKCSNRLVNSGKVKREKRGNGWVKPGKGSETVV

SEQ ID NO: 32904 - protein, 585 aa, Homo sapiens
  Payload ID: 6458
  Gene Symbol: FZD5
  Gene Name: frizzled class receptor 5
  Uniprot ID: Q13467
  ENSP ID: ENSP00000354607
MARPDPSAPPSLLLLLLAQLVGRAAAASKAPVCQEITVPMCRGIGYNLTHMPNQFNHDTQDEAGLEVHQFWPLVEIQCSPDLRFFLCSMYTPICLPDYHKPLPPCRSVCERAKAGCSPLMRQYGFAWPERMSCDRLPVLGRDAEVLCMDYNRSEATTAPPRPFPAKPTLPGPPGAPASGGECPAGGPFVCKCREPFVPILKESHPLYNKVRTGQVPNCAVPCYQPSFSADERTFATFWIGLWSVLCFISTSTTVATFLIDMERFRYPERPIIFLSACYLCVSLGFLVRLVVGHASVACSREHNHIHYETTGPALCTIVFLLVYFFGMASSIWWVILSLTWFLAAGMKWGNEAIAGYAQYFHLAAWLIPSVKSITALALSSVDGDPVAGICYVGNQNLNSLRGFVLGPLVLYLLVGTLFLLAGFVSLFRIRSVIKQGGTKTDKLEKLMIRIGIFTLLYTVPASIVVACYLYEQHYRESWEAALTCACPGHDTGQPRAKPEYWVLMLKYFMCLVVGITSGVWIWSGKTVESWRRFTSRCCCRPRRGHKSGGAMAAGDYPEASAALTGRTGPPGPAATYHKQVSLSHV

SEQ ID NO: 32905 - protein, 706 aa, Homo sapiens
  Payload ID: 6459
  Gene Symbol: FZD6
  Gene Name: frizzled class receptor 6
  Uniprot ID: O60353
  ENSP ID: ENSP00000351605
MEMFTFLLTCIFLPLLRGHSLFTCEPITVPRCMKMAYNMTFFPNLMGHYDQSIAAVEMEHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 32906 - protein, 60 aa, Homo sapiens
  Payload ID: 6459
  Gene Symbol: FZD6
  Gene Name: frizzled class receptor 6
  ENSP ID: ENSP00000427733
MEMFTFLLTCIFLPLLRGHSLFTCEPITVPRCMKMAYNMTFFPNLMGHYDQSIAAVEMEL

SEQ ID NO: 32907 - protein, 64 aa, Homo sapiens
  Payload ID: 6459
  Gene Symbol: FZD6
  Gene Name: frizzled class receptor 6
  ENSP ID: ENSP00000428188
MEMFTFLLTCIFLPLLRGHSLFTCEPITVPRCMKMAYNMTFFPNLMGHYDQSIAAVEMEGTQTG

SEQ ID NO: 32908 - protein, 100 aa, Homo sapiens
  Payload ID: 6459
  Gene Symbol: FZD6
  Gene Name: frizzled class receptor 6
  ENSP ID: ENSP00000428257
MKMAYNMTFFPNLMGHYDQSIAAVEMEHFLPLANLECSPNIETFLCKAFVPTCIEQIHVVPPCRKLCEKVYSDCKKLIDTFGIRWPEELECDSCRKKMEL

SEQ ID NO: 32909 - protein, 467 aa, Homo sapiens
  Payload ID: 6459
  Gene Symbol: FZD6
  Gene Name: frizzled class receptor 6
  ENSP ID: ENSP00000428301
MEMFTFLLTCIFLPLLRGHSLFTCEPITVPRCMKMAYNMTFFPNLMGHYDQSIAAVEMEHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQSNQ

SEQ ID NO: 32910 - protein, 706 aa, Homo sapiens; identical to SEQ ID NO: 32905
  Payload ID: 6459
  Gene Symbol: FZD6
  Gene Name: frizzled class receptor 6
  Uniprot ID: O60353
  ENSP ID: ENSP00000429055

SEQ ID NO: 32911 - protein, 674 aa, Homo sapiens
  Payload ID: 6459
  Gene Symbol: FZD6
  Gene Name: frizzled class receptor 6
  Uniprot ID: O60353
  ENSP ID: ENSP00000429528
MKMAYNMTFFPNLMGHYDQSIAAVEMEHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 32912 - protein, 574 aa, Homo sapiens
  Payload ID: 6460
  Gene Symbol: FZD7
  Gene Name: frizzled class receptor 7
  Uniprot ID: O75084
  ENSP ID: ENSP00000286201
MRDPGAAAPLSSLGLCALVLALLGALSAGAGAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGPGGGPTAYPTAPYLPDLPFTALPPGASDGRGRPAFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 32913 - protein, 694 aa, Homo sapiens
  Payload ID: 6461
  Gene Symbol: FZD8
  Gene Name: frizzled class receptor 8
  Uniprot ID: Q9H461
  ENSP ID: ENSP00000363826
MEWGYLLEVTSLLAALALLQRSSGAAAASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRTDLTTAAPSPPRRLPPPPPGEQPPSGSGHGRPPGARPPHRGGGRGGGGGDAAAPPARGGGGGGKARPPGGGAAPCEPGCQCRAPMVSVSSERHPLYNRVKTGQIANCALPCHNPFFSQDERAFTVFWIGLWSVLCFVSTFATVSTFLIDMERFKYPERPIIFLSACYLFVSVGYLVRLVAGHEKVACSGGAPGAGGAGGAGGAAAGAGAAGAGAGGPGGRGEYEELGAVEQHVRYETTGPALCTVVFLLVYFFGMASSIWWVILSLTWFLAAGMKWGNEAIAGYSQYFHLAAWLVPSVKSIAVLALSSVDGDPVAGICYVGNQSLDNLRGFVLAPLVIYLFIGTMFLLAGFVSLFRIRSVIKQQDGPTKTHKLEKLMIRLGLFTVLYTVPAAVVVACLFYEQHNRPRWEATHNCPCLRDLQPDQARRPDYAVFMLKYFMCLVVGITSGVWVWSGKTLESWRSLCTRCCWASKGAAVGGGAGATAAGGGGGPGGGGGGGPGGGGGPGGGGGSLYSDVSTGLTWRSGTASSVSYPKQMPLSQV

SEQ ID NO: 32914 - protein, 591 aa, Homo sapiens
  Payload ID: 6462
  Gene Symbol: FZD9
  Gene Name: frizzled class receptor 9
  Uniprot ID: O00144
  ENSP ID: ENSP00000345785
MAVAPLRGALLLWQLLAAGGAALEIGRFDPERGRGAAPCQAVEIPMCRGIGYNLTRMPNLLGHTSQGEAAAELAEFAPLVQYGCHSHLRFFLCSLYAPMCTDQVSTPIPACRPMCEQARLRCAPIMEQFNFGWPDSLDCARLPTRNDPHALCMEAPENATAGPAEPHKGLGMLPVAPRPARPPGDLGPGAGGSGTCENPEKFQYVEKSRSCAPRCGPGVEVFWSRRDKDFALVWMAVWSALCFFSTAFTVLTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVILTLRKVAGDELTGLCYVASTDAAALTGFVLVPLSGYLVLGSSFLLTGFVALFHIRKIMKTGGTNTEKLEKLMVKIGVFSILYTVPATCVIVCYVYERLNMDFWRLRATEQPCAAAAGPGGRRDCSLPGGSVPTVAVFMLKIFMSLVVGITSGVWVWSSKTFQTWQSLCYRKIAAGRARAKACRAPGSYGRGTHCHYKAPTVVLHMTKTDPSLENPTHL

SEQ ID NO: 32915 - protein, 325 aa, Homo sapiens
  Payload ID: 6463
  Gene Symbol: FRZB
  Gene Name: frizzled-related protein
  Uniprot ID: Q92765
  ENSP ID: ENSP00000295113
MVCGSPGGMLLLRAGLLALAALCLLRVPGARAAACEPVRIPLCKSLPWNMTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYIIMGYEDEERSRLLLVEGSIAEKWKDRLGKKVKRWDMKLRHLGLSKSDSSNSDSTQSQKSGRNSNPRQARN

SEQ ID NO: 32916 - protein, 309 aa, Homo sapiens
  Payload ID: 6464
  Gene Symbol: FN3K
  Gene Name: fructosamine 3 kinase
  Uniprot ID: Q9H479
  ENSP ID: ENSP00000300784
MEQLLRAELRTATLRAFGGPGAGCISEGRAYDTDAGPVFVKVNRRTQARQMFEGEVASLEALRSTGLVRVPRPMKVIDLPGGGAAFVMEHLKMKSLSSQASKLGEQMADLHLYNQKLREKLKEEENTVGRRGEGAEPQYVDKFGFHTVTCCGFIPQVNEWQDDWPTFFARHRLQAQLDLIEKDYADREARELWSRLQVKIPDLFCGLEIVPALLHGDLWSGNVAEDDVGPIIYDPASFYGHSEFELAIALMFGGFPRSFFTAYHRKIPKAPGFDQRLLLYQLFNYLNHWNHFGREYRSPSLGTMRRLLK

SEQ ID NO: 32917 - protein, 309 aa, Homo sapiens
  Payload ID: 6465
  Gene Symbol: FN3KRP
  Gene Name: fructosamine 3 kinase related protein
  Uniprot ID: Q9HA64
  ENSP ID: ENSP00000269373
MEELLRRELGCSSVRATGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVGRGGGQEERPFVARFGFDVVTCCGYLPQVNDWQEDWVVFYARQRIQPQMDMVEKESGDREALQLWSALQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSSLNIMRNLVK

SEQ ID NO: 32918 - protein, 145 aa, Homo sapiens
  Payload ID: 6465
  Gene Symbol: FN3KRP
  Gene Name: fructosamine 3 kinase related protein
  ENSP ID: ENSP00000458550
MEELLRRELGCSSVRATGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVEHNALSGSREFSGILIC

SEQ ID NO: 32919 - protein, 127 aa, Homo sapiens
  Payload ID: 6465
  Gene Symbol: FN3KRP
  Gene Name: fructosamine 3 kinase related protein
  ENSP ID: ENSP00000459653
MFEGEMASLTAILKTNTVKVPKPIKVLDAPGGGSVLVMEHMDMRHLSSHAAKLGAQLADLHLDNKKLGEMRLKEAGTVGRGGGQEERPFVARFGFDVVTCCGYLPQAPGFEKRLQLYQLFHYLNHWN

SEQ ID NO: 32920 - protein, 50 aa, Homo sapiens
  Payload ID: 6465
  Gene Symbol: FN3KRP
  Gene Name: fructosamine 3 kinase related protein
  ENSP ID: ENSP00000459751
FGSGYRGSSLNIMRNLVKAPQQKAEQNRVPLECWFLCGVRKDRECGQFPT

SEQ ID NO: 32921 - protein, 124 aa, Homo sapiens
  Payload ID: 6465
  Gene Symbol: FN3KRP
  Gene Name: fructosamine 3 kinase related protein
  ENSP ID: ENSP00000460243
MDMVEKESGDREALQLWSALQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSS

SEQ ID NO: 32922 - protein, 102 aa, Homo sapiens
  Payload ID: 6465
  Gene Symbol: FN3KRP
  Gene Name: fructosamine 3 kinase related protein
  ENSP ID: ENSP00000460777
  MOD_RES (1)..(1): Any amino acid
XELLRRELGCSSVRATGHSGGGCISQGRSYDTDQGRVFVKVNPKAEARRMFEGEMASLTAILKTNTVKVPKPIKVLDAPGGGSVLVMEHMDMRHLSSCCRLI

SEQ ID NO: 32923 - protein, 56 aa, Homo sapiens
  Payload ID: 6465
  Gene Symbol: FN3KRP
  Gene Name: fructosamine 3 kinase related protein
  ENSP ID: ENSP00000460869
MEELLRRELGCSSVRATGHSGGGCISQGRSYDTDQGRVFVKVNPKAEVKSDPRSLA

SEQ ID NO: 32924 - protein, 338 aa, Homo sapiens [sequence omitted]

SEQ ID NO: 32925 - protein, 338 aa, Homo sapiens [sequence omitted]

SEQ ID NO: 32926 - protein, 151 aa, Homo sapiens
  Payload ID: 6466
  Gene Symbol: FBP1
  Gene Name: fructose-1,6-bisphosphatase 1
  ENSP ID: ENSP00000411619
MLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYARDFDPAVTEYIQRKKFPP

SEQ ID NO: 32927 - protein, 339 aa, Homo sapiens
  Payload ID: 6467
  Gene Symbol: FBP2
  Gene Name: fructose-1,6-bisphosphatase 2
  Uniprot ID: O00757
  ENSP ID: ENSP00000364486
MTDRSPFETDMLTLTRYVMEKGRQAKGTGELTQLLNSMLTAIKAISSAVRKAGLAHLYGIAGSVNVTGDEVKKLDVLSNSLVINMVQSSYSTCVLVSEENKDAIITAKEKRGKYVVCFDPLDGSSNIDCLASIGTIFAIYRKTSEDEPSEKDALQCGRNIVAAGYALYGSATLVALSTGQGVDLFMLDPALGEFVLVEKDVKIKKKGKIYSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPEAIHQRVPLILGSPEDVQEYLTCVQKNQAGS

SEQ ID NO: 32928 - protein, 3013 aa, Homo sapiens
  Payload ID: 6468
  Gene Symbol: FRYL
  Gene Name: FRY-like
  Uniprot ID: O94915
  ENSP ID: ENSP00000351113
MSNITIDPDVKPGEYVIKSLFAEFAVQAEKKIEVVMAEPLEKLLSRSLQRGEDLQFDQLISSMSSVAEHCLPSLLRTLFDWYRRQNGTEDESYEYRPRSSTKSKGDEQQRERDYLLERRDLAVDFIFCLVLVEVLKQIPVHPVPDPLVHEVLNLAFKHFKHKEGYSGTNTGNVHIIADLYAEVIGVLAQSKFQAVRKKFVTELKELRQKEQSPHVVQSVISLIMGMKFFRVKMYPVEDFEASFQFMQECAQYFLEVKDKDIKHALAGLFVEILIPVAAAVKNEVNVPCLKNFVEMLYQTTFELSSRKKHSLALYPLITCLLCVSQKQFFLNNWHIFLQNCLSHLKNKDPKMSRVALESLYRLLWVYVIRIKCESNTVTQSRLMSIVSALFPKGSRSVVPRDTPLNIFVKIIQFIAQERLDFAMKEIIFDLLSVGKSTKTFTINPERMNIGLRVFLVIADSLQQKDGEPPMPTTGVILPSGNTLRVKKIFLNKTLTDEEAKVIGMSVYYPQVRKALDSILRHLDKEVGRPMCMTSVQMSNKEPEDMITGERKPKIDLFRTCIAAIPRLIPDGMSRTDLIELLARLTIHMDEELRALAFNTLQALMLDFPDWREDVLSGFVYFIVREVTDVHPTLLDNAVKMLVQLINQWKQAAQMHNKNQDTQHGVANGASHPPPLERSPYSNVFHVVEGFALVILCSSRPATRRLAVSVLREIRALFALLEIPKGDDELAIDVMDRLSPSILESFIHLTGADQTTLLYCPSSIDLQTLAEWNSSPISHQFDVISPSHIWIFAHVTQGQDPWIISLSSFLKQENLPKHCSTAVSYAWMFAYTRLQLLSPQVDINSPINAKKVNTTTSSDSYIGLWRNYLILCCSAATSSSSTSAGSVRCSPPETLASTPDSGYSIDSKIIGIPSPSSLFKHIVPMMRSESMEITESLVLGLGRTNPGAFRELIEELHPIIKEALERRPENMKRRRRRDILRVQLVRIFELLADAGVISHSASGGLDNETHFLNNTLLEYVDLTRQLLEAENEKDSDTLKDIRCHFSALVANIIQNVPVHQRRSIFPQQSLRHSLFMLFSHWAGPFSIMFTPLDRYSDRNMQINRHQYCALKAMSAVLCCGPVADNVGLSSDGYLYKWLDNILDSLDKKVHQLGCEAVTLLLELNPDQSNLMYWAVDRCYTGSGRVAAGCFKAIANVFQNRDYQCDTVMLLNLILFKAADSSRSIYEVAMQLLQILEPKMFRYAHKLEVQRTDGVLSQLSPLPHLYSVSYYQLSEELARAYPELTLAIFSEISQRIQTAHPAGRQVMLHYLLPWMNNIELVDLKPLPTARRHDEDEDDSLKDRELMVTSRRWLRGEGWGSPQATAMVLNNLMYMTAKYGDELAWSEVENVWTTLADGWPKNLKIILHFLISICGVNSEPSLLPYVKKVIVYLGRDKTMQLLEELVSELQLTDPVSSGVTHMDNPPYYRITSSYKIPSVTSGTTSSSNTMVAPTDGNPDNKPIKENIEESYVHLDIYSGLNSHLNRQHHRLESRYSSSSGGSYEEEKSDSMPLYSNWRLKVMEHNQGEPLPFPPAGGCWSPLVDYVPETSSPGLPLHRCNIAVILLTDLIIDHSVKVEWGSYLHLLLHAIFIGFDHCHPEVYEHCKRLLLHLLIVMGPNSNIRTVASVLLRNKEFNEPRVLTVKQVAHLDYNFTAGINDFIPDYQPSPMTDSGLSSSSTSSSISLGNNSAAISHLHTTILNEVDISVEQDGKVKTLMEFITSRKRGPLWNHEDVSAKNPSIKSAEQLTTFLKHVVSVFKQSSSEGIHLEHHLSEVALQTALSCSSRHYAGRSFQIFRALKQPLTATTLSDVLSRLVETVGDPGEDAQGFVIELLLTLESAIDTLAETMKHYDLLSALSQTSYHDPIMGNKYAANRKSTGQLNLSTSPINSSSYLGYNSNARSNSLRLSLIGDRRGDRRRSNTLDIMDGRINHSSSLARTRSLSSLREKGMYDVQSTTEPTNLMATIFWIAASLLESDYEYEYLLALRLLNKLLIHLPLDKSESREKIENVQSKLKWTNFPGLQQLFLKGFTSASTQEMTVHLLSKLISVSKHTLVDPSQLSGFPLNILCLLPHLIQHFDSPTQFCKETASRIAKVCAEEKCPTLVNLAHMMSLYSTHTYSRDCSNWINVVCRYLHDSFSDTTFNLVTYLAELLEKGLSSMQQSLLQIIYSLLSHIDLSAAPAKQFNLEIIKIIGKYVQSPYWKEALNILKLVVSRSASLVVPSDIPKTYGGDTGSPEISFTKIFNNVSKELPGKTLDFHFDISETPIIGNKYGDQHSAAGRNGKPKVIAVTRSTSSTSSGSNSNALVPVSWKRPQLSQRRTREKLMNVLSLCGPESGLPKNPSVVFSSNEDLEVGDQQTSLISTTEDINQEEEVAVEDNSSEQQFGVFKDFDFLDVELEDAEGESMDNFNWGVRRRSLDSIDKGDTPSLQEYQCSSSTPSLNLTNQEDTDESSEEEAALTASQILSRTQMLNSDSATDETIPDHPDLLLQSEDSTGSITTEEVLQIRDETPTLEASLDNANSRLPEDTTSVLKEEHVTTFEDEGSYIIQEQQESLVCQGILDLEETEMPEPLAPESYPESVCEEDVTLALKELDERCEEEEADFSGLSSQDEEEQDGFPEVQTSPLPSPFLSAIIAAFQPVAYDDEEEAWRCHVNQMLSDTDGSSAVFTFHVFSRLFQTIQRKFGEITNEAVSFLGDSLQRIGTKFKSSLEVMMLCSECPTVFVDAETLMSCGLLETLKFGVLELQEHLDTYNVKREAAEQWLDDCKRTFGAKEDMYRINTDAQQMEILAELELCRRLYKLHFQLLLLFQAYCKLINQVNTIKNEAEVINMSEELAQLESILKEAESASENEEIDISKAAQTTIETAIHSLIETLKNKEFISAVAQVKAFRSLWPSDIFGSCEDDPVQTLLHIYFHHQTLGQTGSFAVIGSNLDMSEANYKLMELNLEIRESLRMVQSYQLLAQAKPMGNMVSTGF

SEQ ID NO: 32929 - protein, 1553 aa, Homo sapiens
  Payload ID: 6468
  Gene Symbol: FRYL
  Gene Name: FRY-like
  ENSP ID: ENSP00000421584
MSNITIDPDVKPGEYVIKSLFAEFAVQAEKKIEVVMAEPLEKLLSRSLQRGEDLQFDQLISSMSSVAEHCLPSLLRTLFDWYRRQNGTEDESYEYRPRSSTKSKGDEQQRERDYLLERRDLAVDFIFCLVLVEVLKQIPVHPVPDPLVHEVLNLAFKHFKHKEGYSGTNTGNVHIIADLYAEVIGVLAQSKFQAVRKKFVTELKELRQKEQSPHVVQSVISLIMGMKFFRVKMYPVEDFEASFQFMQECAQYFLEVKDKDIKHALAGLFVEILIPVAAAVKNEVNVPCLKNFVEMLYQTTFELSSRKKHSLALYPLITCLLCVSQKQFFLNNWHIFLQNCLSHLKNKDPKMSRVALESLYRLLWVYVIRIKCESNTVTQSRLMSIVSALFPKGSRSVVPRDTPLNIFVKIIQFIAQERLDFAMKEIIFDLLSVGKSTKTFTINPERMNIGLRVFLVIADSLQQKDGEPPMPTTGVILPSGNTLRVKKIFLNKTLTDEEAKVIGMSVYYPQVRKALDSILRHLDKEVGRPMCMTSVQMSNKEPEDMITGERKPKIDLFRTCIAAIPRLIPDGMSRTDLIELLARLTIHMDEELRALAFNTLQALMLDFPDWREDVLSGFVYFIVREVTDVHPTLLDNAVKMLVQLINQWKQAAQMHNKNQDTQHGVANGASHPPPLERSPYSNVFHVVEGFALVILCSSRPATRRLAVSVLREIRALFALLEIPKGDDELAIDVMDRLSPSILESFIHLTGADQTTLLYCPSSIDLQTLAEWNSSPISHQFDVISPSHIWIFAHVTQGQDPWIISLSSFLKQENLPKHCSTAVSYAWMFAYTRLQLLSPQVDINSPINAKKVNTTTSSDSYIGLWRNYLILCCSAATSSSSTSAGSVRCSPPETLASTPDSGYSIDSKIIGIPSPSSLFKHIVPMMRSESMEITESLVLGLGRTNPGAFRELIEELHPIIKEALERRPENMKRRRRRDILRVQLVRIFELLADAGVISHSASGGLDNETHFLNNTLLEYVDLTRQLLEAENEKDSDTLKDIRCHFSALVANIIQNVPVHQRRSIFPQQSLRHSLFMLFSHWAGPFSIMFTPLDRYSDRNMQINRHQYCALKAMSAVLCCGPVADNVGLSSDGYLYKWLDNILDSLDKKVHQLGCEAVTLLLELNPDQSNLMYWAVDRCYTGSGRVAAGCFKAIANVFQNRDYQCDTVMLLNLILFKAADSSRSIYEVAMQLLQILEPKMFRYAHKLEVQRTDGVLSQLSPLPHLYSVSYYQLSEELARAYPELTLAIFSEISQRIQTAHPAGRQVMLHYLLPWMNNIELVDLKPLPTARRHDEDEDDSLKDRELMVTSRRWLRGEGWGSPQATAMVLNNLMYMTAKYGDELAWSEVENVWTTLADGWPKNLKIILHFLISICGVNSEPSLLPYVKKVIVYLGRDKTMQLLEELVSELQLTDPVSSGVTHMDNPPYYRITSSYKIPSVTSGTTSSSNTMVAPTDGNPDNKPIKENIEESYVHLDIYSGLNSHLNRQHHRLESRYSSSSGGSYEEEKSNKFQMFLI

SEQ ID NO: 32930 - protein, 403 aa, Homo sapiens
  Payload ID: 6468
  Gene Symbol: FRYL
  Gene Name: FRY-like
  Uniprot ID: O94915
  ENSP ID: ENSP00000422408
MPEPLAPESYPESVCEEDVTLALKELDERCEEEEADFSGLSSQDEEEQDGFPEVQTSPLPSPFLSAIIAAFQPVAYDDEEEAWRCHVNQMLSDTDGSSAVFTFHVFSRLFQTIQRKFGEITNEAVSFLGDSLQRIGTKFKSSLEVMMLCSECPTVFVDAETLMSCGLLETLKFGVLELQEHLDTYNVKREAAEQWLDDCKRTFGAKEDMYRINTDAQELELCRRLYKLHFQLLLLFQAYCKLINQVNTIKNEAEVINMSEELAQLESILKEAESASENEEIDISKAAQTTIETAIHSLIETLKNKEFISAVAQVKAFRSLWPSDIFGSCEDDPVQTLLHIYFHHQTLGQTGSFAVIGSNLDMSEANYKLMELNLEIRESLRMVQSYQLLAQAKPMGNMVSTGF

SEQ ID NO: 32931 - protein, 190 aa, Homo sapiens
  Payload ID: 6468
  Gene Symbol: FRYL
  Gene Name: FRY-like
  ENSP ID: ENSP00000422988
MDFLKRVVPPILSGDVVLDTSTEESSPRLVKMKRLSSLSSEKTVDEQGGTNFCHSNYDKYEHQQLASAPVSKVNKYCASSNFHSTWGKKNIIMSNITIDPDVKPGEYVIKSLFAEFAVQAEKKIEVVMAEPLEKLLSRSLQRGEDLQFDQLISSMSSVAEHCLPSLLRTLFDWYRRQNGTEDESYEYRPR

SEQ ID NO: 32932 - protein, 1455 aa, Homo sapiens
  Payload ID: 6468
  Gene Symbol: FRYL
  Gene Name: FRY-like
  ENSP ID: ENSP00000425344
  MOD_RES (1)..(1): Any amino acid
XGYLYKWLDNILDSLDKKVHQLGCEAVTLLLELNPDQSNLMYWAVDRCYTGSGRVAAGCFKAIANVFQNRDYQCDTVMLLNLILFKAADSSRSIYEVAMQLLQILEPKMFRYAHKLEVQRTDGVLSQLSPLPHLYSVSYYQLSEELARAYPELTLAIFSEISQRIQTAHPAGRQVMLHYLLPWMNNIELVDLKPLPTARRHDEDEDDSLKDRELMVTSRRWLRGEGWGSPQATAMVLNNLMYMTAKYGDELAWSEVENVWTTLADGWPKNLKIILHFLISICGVNSEPSLLPYVKKVIVYLGRDKTMQLLEELVSELQLTDPVSSGVTHMDNPPYYRITSSYKIPSVTSGTTSSSNTMVAPTDGNPDNKPIKENIEESYVHLDIYSGLNSHLNRQHHRLESRYSSSSGGSYEEEKSDSMPLYSNWRLKVMEHNQGEPLPFPPAGGCWSPLVDYVPETSSPGLPLHRCNIAVILLTDLIIDHSVKVEWGSYLHLLLHAIFIGFDHCHPEVYEHCKRLLLHLLIVMGPNSNIRTVASVLLRNKEFNEPRVLTVKQVAHLDYNFTGINDFIPDYQPSPMTDSGLSSSSTSSSISLGNNSAAISHLHTTILNEVDISVEQDGKVKTLMEFITSRKRGPLWNHEDVSAKNPSIKSAEQLTTFLKHVVSVFKQSSSEGIHLEHHLSEVALQTALSCSSRHYAGRSFQIFRALKQPLTATTLSDVLSRLVETVGDPGEDAQGFVIELLLTLESAIDTLAETMKHYDLLSALSQTSYHDPIMGNKYAANRKSTGQLNLSTSPINSSSYLGYNSNARSNSLRLSLIGDRRGDRRRSNTLDIMDGRINHSSSLARTRSLSSLREKGMYDVQSTTEPTNLMATIFWIAASLLESDYEYEYLLALRLLNKLLIHLPLDKSESREKIENVQSKLKWTNFPGLQQLFLKGFTSASTQEMTVHLLSKLISVSKHTLVDPSQLSGFPLNILCLLPHLIQHFDSPTQFCKETASRIAKVCAEEKCPTLVNLAHMMSLYSTHTYSRDCSNWINVVCRYLHDSFSDTTFNLVTYLAELLEKGLSSMQQSLLQIIYSLLSHIDLSAAPAKQFNLEIIKIIGKYVQSPYWKEALNILKLVVSRSASLVVPSDIPKTYGGDTGSPEISFTKIFNNVSKELPGKTLDFHFDISETPIIGNKYGDQHSAAGRNGKPKVIAVTRSTSSTSSGSNSNALVPVSWKRPQLSQRRTREKLMNVLSLCGPESGLPKNPSVVFSSNEDLEVGDQQTSLISTTEDINQEEEVAVEDNSSEQQFGVFKDFDFLDVELEDAEGESMDNFNWGVRRRSLDSIDKGDTPSLQEYQCSSSTPSLNLTNQEDTDESSEEEAALTASQILSRTQMLNSDSATDETIPDHPDLLLQSEDSTGSITTEEVLQIRDETPTLEASLDNANSRLPEDTTSVLKEEHVTTFEDEGSYII

SEQ ID NO: 32933 - protein, 471 aa, Homo sapiens
  Payload ID: 6468
  Gene Symbol: FRYL
  Gene Name: FRY-like
  ENSP ID: ENSP00000425592
MLYQTTFELSSRKKHSLALYPLITCLLCVSQKQFFLNNWHIFLQNCLSHLKNKDPKMSRVALESLYRLLWVYVIRIKCESNTVTQSRLMSIVSALFPKGSRSVVPRDTPLNIFVKIIQFIAQERLDFAMKEIIFDLLSVGKSTKTFTINPERMNIGLRVFLVIADSLQQKDGEPPMPTTGVILPSGNTLRVKKIFLNKTLTDEEAKVIGMSVYYPQVRKALDSILRHLDKEVGRPMCMTSVQMSNKEPEDMITGERKPKIDLFRTCIAAIPRLIPDGMSRTDLIELLARLTIHMDEELRALAFNTLQALMLDFPDWREDVLSGFVYFIVREVTDVHPTLLDNAVKMLVQLINQWKQAAQMHNKNQDTQHGVANGASHPPPLERSPYSNVFHVVEGFALVILCSSRPATRRLAVSVLREIRALFALLEIPKGDDELAIDVMDRLSPSILESFIHLTGADQVTIVTSFYPILF

SEQ ID NO: 32934 - protein, 3013 aa, Homo sapiens; identical to SEQ ID NO: 32928
  Payload ID: 6468
  Gene Symbol: FRYL
  Gene Name: FRY-like
  Uniprot ID: O94915
  ENSP ID: ENSP00000426064

SEQ ID NO: 32935 - protein, 258 aa, Homo sapiens
  Payload ID: 6469
  Gene Symbol: FRG1
  Gene Name: FSHD region gene 1
  Uniprot ID: Q14331
  ENSP ID: ENSP00000226798
MAEYSYVKSTKLVLKGTKTKSKKKKSKDKKRKREEDEETQLDIVGIWWTVTNFGEISGTIAIEMDKGTYIHALDNGLFTLGAPHKEVDEGPSPPEQFTAVKLSDSRIALKSGYGKYLGINSDGLVVGRSDAIGPREQWEPVFQNGKMALLASNSCFIRCNEAGDIEAKSKTAGEEEMIKIRSCAERETKKKDDIPEEDKGNVKQCEINYVKKFQSFQDHKLKISKEDSKILKKARKDGFLHETLLDRRAKLKADRYCK

SEQ ID NO: 32936 - protein, 102 aa, Homo sapiens
  Payload ID: 6469
  Gene Symbol: FRG1
  Gene Name: FSHD region gene 1
  ENSP ID: ENSP00000435067
MHSTMVFLPWELHTKKGKMALLASNSCFIRCNEAGDIEAKSKTAGEEEMIKIRSCAERETKKKDDIPEEDKGNVKQCEINYVKKFQSFQDHKLKISKEDSKI

SEQ ID NO: 32937 - protein, 116 aa, Homo sapiens
  Payload ID: 6469
  Gene Symbol: FRG1
  Gene Name: FSHD region gene 1
  ENSP ID: ENSP00000435943
MDKGTYIHALDNGLFTLGAPHKEVDEGPSPPEQFTAVKLSDSRIALKSGYGKYLGINSDGLVVGRSDAIGPREQWEPVFQNGKMALLASNSCFIRCNEAGDIEAKSKTAGEEEMIK

SEQ ID NO: 32938 - protein, 42 aa, Homo sapiens
  Payload ID: 6469
  Gene Symbol: FRG1
  Gene Name: FSHD region gene 1
  ENSP ID: ENSP00000436535
MAEYSYVKSTKLVLKGTKTKRFARGTYKCRVFPPGLRDKQRF

SEQ ID NO: 32939 - protein, 84 aa, Homo sapiens
  Payload ID: 6469
  Gene Symbol: FRG1
  Gene Name: FSHD region gene 1
  ENSP ID: ENSP00000462603
IRSCAERETKKKDDIPEEDKGNVKQCEINYVWSLALSPRLECHGAISAHRNLRFPGSCDSPASASRVAGTTERNFRASKTTNLK

SEQ ID NO: 32940 - protein, 258 aa, Homo sapiens; identical to SEQ ID NO: 32935
  Payload ID: 6469
  Gene Symbol: FRG1
  Gene Name: FSHD region gene 1
  Uniprot ID: Q14331
  ENSP ID: ENSP00000483471

SEQ ID NO: 32941 - protein, 102 aa, Homo sapiens; identical to SEQ ID NO: 32936
  Payload ID: 6469
  Gene Symbol: FRG1
  Gene Name: FSHD region gene 1
  ENSP ID: ENSP00000485342

SEQ ID NO: 32942 - protein, 42 aa, Homo sapiens; identical to SEQ ID NO: 32938
  Payload ID: 6469
  Gene Symbol: FRG1
  Gene Name: FSHD region gene 1
  ENSP ID: ENSP00000486096

SEQ ID NO: 32943 - protein, 116 aa, Homo sapiens; identical to SEQ ID NO: 32937
  Payload ID: 6469
  Gene Symbol: FRG1
  Gene Name: FSHD region gene 1
  ENSP ID: ENSP00000486212

SEQ ID NO: 32944 - protein, 84 aa, Homo sapiens; identical to SEQ ID NO: 32939
  Payload ID: 6469
  Gene Symbol: FRG1
  Gene Name: FSHD region gene 1
  ENSP ID: ENSP00000487528

SEQ ID NO: 32945 - protein, 278 aa, Homo sapiens
  Payload ID: 6470
  Gene Symbol: FRG2
  Gene Name: FSHD region gene 2
  Uniprot ID: Q64ET8
  ENSP ID: ENSP00000368039
MGKGNEDSDLHCSSIQCSTDQPPFQQISFTEKGSDEKKPFKEKGKTAFSHSSEKHIQRQGSEPNPNKENSEETKLKAGNSTAGSEPESSSYRENCRKRKMSSKDSCQDTAGNCPEKECSLSLNKKSRSSTAVHNSEIQETCDAHHRGHSRACTGHSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 32946 - protein, 279 aa, Homo sapiens
  Payload ID: 6470
  Gene Symbol: FRG2
  Gene Name: FSHD region gene 2
  Uniprot ID: Q64ET8
  ENSP ID: ENSP00000424015
MGKGNEDSDLHCSSIQCSTDQPPFQQISFTEKGSDEKKPFKEKGKTAFSHSSEKHIQRQAGSEPNPNKENSEETKLKAGNSTAGSEPESSSYRENCRKRKMSSKDSCQDTAGNCPEKECSLSLNKKSRSSTAVHNSEIQETCDAHHRGHSRACTGHSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 32947 - protein, 278 aa, Homo sapiens; identical to SEQ ID NO: 32945
  Payload ID: 6470
  Gene Symbol: FRG2
  Gene Name: FSHD region gene 2
  Uniprot ID: Q64ET8
  ENSP ID: ENSP00000482196

SEQ ID NO: 32948 - protein, 279 aa, Homo sapiens; identical to SEQ ID NO: 32946
  Payload ID: 6470
  Gene Symbol: FRG2
  Gene Name: FSHD region gene 2
  Uniprot ID: Q64ET8
  ENSP ID: ENSP00000485877

SEQ ID NO: 32949 - protein, 278 aa, Homo sapiens
  Payload ID: 6471
  Gene Symbol: FRG2B
  Gene Name: FSHD region gene 2 family, member B
  Uniprot ID: Q96QU4
  ENSP ID: ENSP00000401310
MGKGNEDPDLHCSSIQCSTDQPPFQQISFTEKGSDEKKPFKEKGKTAFSHSSEKHIQRQGSEPNPNKENSEETKLKAGNSTAGSEPESSSYRENCRKRKMSSKDSCQDTAGNCPEKECSLSLNKKSRSSTPVHNSEIQETCDAHHRGRSRACTGRSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 32950 - protein, 279 aa, Homo sapiens
  Payload ID: 6471
  Gene Symbol: FRG2B
  Gene Name: FSHD region gene 2 family, member B
  ENSP ID: ENSP00000408343
MGKGNEDPDLHCSSIQCSTDQPPFQQISFTEKGSDEKKPFKEKGKTAFSHSSEKHIQRQAGSEPNPNKENSEETKLKAGNSTAGSEPESSSYRENCRKRKMSSKDSCQDTAGNCPEKECSLSLNKKSRSSTPVHNSEIQETCDAHHRGRSRACTGRSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 32951 - protein, 282 aa, Homo sapiens
  Payload ID: 6472
  Gene Symbol: FRG2C
  Gene Name: FSHD region gene 2 family, member C
  Uniprot ID: A6NGY1
  ENSP ID: ENSP00000312299
MGKGNEDPDLHCSSIQCSTDQPPFQQISFTEKGSDEKKPFKGKGKTAFSHSSEKHTQRQAGSDPNPNKENSEETKLKAGNSTAGSEPESSSYQENCRKRKISSKDICQDRAGNCPEEECNLTLNKKSRSSTAVHNSEIQETCDAHHRGSSRACTGRSKRHRSRALEVQTPSLRKSLVTSVRAMSEAVYQDLAQVWAQQIHSPLTCEQLTLLTRLRGPLCAQVQTLYSMATQAAYVFPAESWLVPATLPGPGDSALDREAHPFPGQEITEPVSGSDEAKLGAP

SEQ ID NO: 32952 - protein, 281 aa, Homo sapiens
  Payload ID: 6472
  Gene Symbol: FRG2C
  Gene Name: FSHD region gene 2 family, member C
  ENSP ID: ENSP00000419432
MGKGNEDPDLHCSSIQCSTDQPPFQQISFTEKGSDEKKPFKGKGKTAFSHSSEKHTQRQGSDPNPNKENSEETKLKAGNSTAGSEPESSSYQENCRKRKISSKDICQDRAGNCPEEECNLTLNKKSRSSTAVHNSEIQETCDAHHRGSSRACTGRSKRHRSRALEVQTPSLRKSLVTSVRAMSEAVYQDLAQVWAQQIHSPLTCEQLTLLTRLRGPLCAQVQTLYSMATQAAYVFPAESWLVPATLPGPGDSALDREAHPFPGQEITEPVSGSDEAKLGAP

SEQ ID NO: 32953 - protein, 847 aa, Homo sapiens
  Payload ID: 6473
  Gene Symbol: FTSJ3
  Gene Name: FtsJ homolog 3 (E. coli)
  Uniprot ID: Q8IY81
  ENSP ID: ENSP00000396673
MGKKGKVGKSRRDKFYHLAKETGYRSRSAFKLIQLNRRFQFLQKARALLDLCAAPGGWLQVAAKFMPVSSLIVGVDLVPIKPLPNVVTLQQDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVTDFLRAANPVDFLSKASEIMVDDEELAQHPATTEDIRVCCQDIRVLGRKELRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLSTIRGHQLLEEVTQGDMSAADTFLSDLPRDDIYVSDVEDDGDDTSLDSDLDPEELAGVRGHQGLRDQKRMRLTEVQDDKEEEEEENPLLVPLEEKAVLQEEQANLWFSKGSFAGIEDDADEALEISQAQLLFENRRKGRQQQQKQQLPQTPPSCLKTEIMSPLYQDEAPKGTEASSGTEAATGLEGEEKDGISDSDSSTSSEEEESWEPLRGKKRSRGPKSDDDGFEIVPIEDPAKHRILDPEGLALGAVIASSKKAKRDLIDNSFNRYTFNEDEGELPEWFVQEEKQHRIRQLPVGKKEVEHYRKRWREINARPIKKVAEAKARKKRRMLKRLEQTRKKAEAVVNTVDISEREKVAQLRSLYKKAGLGKEKRHVTYVVAKKGVGRKVRRPAGVRGHFKVVDSRMKKDQRAQQRKEQKKKHKRK

SEQ ID NO: 32954 - protein, 29 aa, Homo sapiens
  Payload ID: 6473
  Gene Symbol: FTSJ3
  Gene Name: FtsJ homolog 3 (E. coli)
  ENSP ID: ENSP00000462212
DLPGVSIADEGETGMFSLSTIRGHQYATY

SEQ ID NO: 32955 - protein, 151 aa, Homo sapiens
  Payload ID: 6473
  Gene Symbol: FTSJ3
  Gene Name: FtsJ homolog 3 (E. coli)
  ENSP ID: ENSP00000462290
MGKKGKVGKSRRDKFYHLAKETGYRSRSAFKLIQLNRRFQFLQKARALLDLCAAPGGWLQVAAKFMPVSSLIVGVDLVPIKPLPNVVTLQQDITTERCRQALRKELKTWKVDVVLNDGAPNVGASWVHDAYSQAHLTLMALRLACDFLARG

SEQ ID NO: 32956 - protein, 67 aa, Homo sapiens
  Payload ID: 6473
  Gene Symbol: FTSJ3
  Gene Name: FtsJ homolog 3 (E. coli)
  ENSP ID: ENSP00000462342
MGKKGKVGKSRRDKFYHLAKETGYRSRSAFKLIQLNRRFQFLQKARALLDLCAAPGGWFVTLATGCR

SEQ ID NO: 32957 - protein, 19 aa, Homo sapiens
  Payload ID: 6473
  Gene Symbol: FTSJ3
  Gene Name: FtsJ homolog 3 (E. coli)
  ENSP ID: ENSP00000463229
MGKKGKVGKSRRDKFYHLA

SEQ ID NO: 32958 - protein, 40 aa, Homo sapiens
  Payload ID: 6473
  Gene Symbol: FTSJ3
  Gene Name: FtsJ homolog 3 (E. coli)
  ENSP ID: ENSP00000463980
MGKKGKVGKSRRDKFYHLAKETVCALGCFVQVTVPDLLSS

SEQ ID NO: 32959 - protein, 33 aa, Homo sapiens
  Payload ID: 6473
  Gene Symbol: FTSJ3
  Gene Name: FtsJ homolog 3 (E. coli)
  ENSP ID: ENSP00000464361
MGKKGKVGKSRRDKFYHLAKETGYRSRSAFKLI

SEQ ID NO: 32960 - protein, 115 aa, Homo sapiens
  Payload ID: 6473
  Gene Symbol: FTSJ3
  Gene Name: FtsJ homolog 3 (E. coli)
  ENSP ID: ENSP00000464648
MGKKGKVGKSRRDKFYHLAKETGYRSRSAFKLIQLNRRFQFLQKARALLDLCAAPGGWLQVAAKFMPVSSLIVGVDLVPIKPLPNVVTLQQDITTERCRQALRKELKTWKVDVVL

SEQ ID NO: 32961 - protein, 327 aa, Homo sapiens
  Payload ID: 6474
  Gene Symbol: FTSJ1
  Gene Name: FtsJ RNA methyltransferase homolog 1 (E. coli)
  Uniprot ID: Q9UET6
  ENSP ID: ENSP00000019019
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 32962 - protein, 329 aa, Homo sapiens
  Payload ID: 6474
  Gene Symbol: FTSJ1
  Gene Name: FtsJ RNA methyltransferase homolog 1 (E. coli)
  Uniprot ID: Q9UET6
  ENSP ID: ENSP00000326948
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 32963 - protein, 192 aa, Homo sapiens
  Payload ID: 6474
  Gene Symbol: FTSJ1
  Gene Name: FtsJ RNA methyltransferase homolog 1 (E. coli)
  ENSP ID: ENSP00000380103
MALNIATHVLKPGGCFVAKIFRGRDVTLLYSQLQVFFSSVLCAKPRSSRNSSIEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 32964 - protein, 246 aa, Homo sapiens
  Payload ID: 6475
  Gene Symbol: FTSJ2
  Gene Name: FtsJ RNA methyltransferase homolog 2 (E. coli)
  Uniprot ID: Q9UI43
  ENSP ID: ENSP00000242257
MAGYLKLVCVSFQRQGFHTVGSRCKNRTGAEHLWLTRHLRDPFVKAAKVESYRCRSAFKLLEVNERHQILRPGLRVLDCGAAPGAWSQVAVQKVNAAGTDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 32965 - protein, 152 aa, Homo sapiens
  Payload ID: 6475
  Gene Symbol: FTSJ2
  Gene Name: FtsJ RNA methyltransferase homolog 2 (E. coli)
  ENSP ID: ENSP00000384423
MRPPADPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 32966 - protein, 246 aa, Homo sapiens; identical to SEQ ID NO: 32964
  Payload ID: 6475
  Gene Symbol: FTSJ2
  Gene Name: FtsJ RNA methyltransferase homolog 2 (E. coli)
  Uniprot ID: Q9UI43
  ENSP ID: ENSP00000392343

SEQ ID NO: 32967 - protein, 1084 aa, Homo sapiens
  Payload ID: 6476
  Gene Symbol: FUK
  Gene Name: fucokinase
  Uniprot ID: Q8N0W3
  ENSP ID: ENSP00000288078
MEQPKGVDWTVIILTCQYKDSVQVFQRELEVRQKREQIPAGTLLLAVEDPEKRVGSGGATLNALLVAAEHLSARAGFTVVTSDVLHSAWILILHMGRDFPFDDCGRAFTCLPVENPEAPVEALVCNLDCLLDIMTYRLGPGSPPGVWVCSTDMLLSVPANPGISWDSFRGARVIALPGSPAYAQNHGVYLTDPQGLVLDIYYQGTEAEIQRCVRPDGRVPLVSGVVFFSVETAERLLATHVSPPLDACTYLGLDSGARPVQLSLFFDILHCMAENVTREDFLVGRPPELGQGDADVAGYLQSARAQLWRELRDQPLTMAYVSSGSYSYMTSSASEFLLSLTLPGAPGAQIVHSQVEEQQLLAAGSSVVSCLLEGPVQLGPGSVLQHCHLQGPIHIGAGCLVTGLDTAHSKALHGRELRDLVLQGHHTRLHGSPGHAFTLVGRLDSWERQGAGTYLNVPWSEFFKRTGVRAWDLWDPETLPAEYCLPSARLFPVLHPSRELGPQDLLWMLDHQEDGGEALRAWRASWRLSWEQLQPCLDRAATLASRRDLFFRQALHKARHVLEARQDLSLRPLIWAAVREGCPGPLLATLDQVAAGAGDPGVAARALACVADVLGCMAEGRGGLRSGPAANPEWMRPFSYLECGDLAAGVEALAQERDKWLSRPALLVRAARHYEGAGQILIRQAVMSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGALLKAAFICAGIVHVHSELQLSEQLLRTFGGGFELHTWSELPHGSGLGTSSILAGTALAALQRAAGRVVGTEALIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSLPLLGQCLTSYWEQKKLMAPGCEPLTVRRMMDVLAPHVHGQSLAGAGGGGFLYLLTKEPQQKEALEAVLAKTEGLGNYSIHLVEVDTQGLSLKLLGTEASTCCPFP

SEQ ID NO: 32968 - protein, 1090 aa, Homo sapiens
  Payload ID: 6476
  Gene Symbol: FUK
  Gene Name: fucokinase
  Uniprot ID: Q8N0W3
  ENSP ID: ENSP00000368192
MEQPKGVDWTVIILTCQYKDSVQVFQRELEVRQKREQIPAGTLLLAVEDPEKRVGSGGATLNALLVAAEHLSARAGFTWICVGVSLWIRGCHPPGRLPEASVHRAFPLLQVVTSDVLHSAWILILHMGRDFPFDDCGRAFTCLPVENPEAPVEALVCNLDCLLDIMTYRLGPGSPPGVWVCSTDMLLSVPANPGISWDSFRGARVIALPGSPAYAQNHGVYLTDPQGLVLDIYYQGTEAEIQRCVRPDGRVPLVSGVVFFSVETAERLLATHVSPPLDACTYLGLDSGARPVQLSLFFDILHCMAENVTREDFLVGRPPELGQGDADVAGYLQSARAQLWRELRDQPLTMAYVSSGSYSYMTSSASEFLLSLTLPGAPGAQIVHSQVEEQQLLAAGSSVVSCLLEGPVQLGPGSVLQHCHLQGPIHIGAGCLVTGLDTAHSKALHGRELRDLVLQGHHTRLHGSPGHAFTLVGRLDSWERQGAGTYLNVPWSEFFKRTGVRAWDLWDPETLPAEYCLPSARLFPVLHPSRELGPQDLLWMLDHQEDGGEALRAWRASWRLSWEQLQPCLDRAATLASRRDLFFRQALHKARHVLEARQDLSLRPLIWAAVREGCPGPLLATLDQVAAGAGDPGVAARALACVADVLGCMAEGRGGLRSGPAANPEWMRPFSYLECGDLAAGVEALAQERDKWLSRPALLVRAARHYEGAGQILIRQAVMSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGALLKAAFICAGIVHVHSELQLSTSSILAGTALAALQRAAGRVVGTEALIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSLPLLGQCLTSYWEQKKLMAPGCEPLTVRRMMDVLAPHVHGQSLAGAGGGGFLYLLTKEPQQKEALEAVLAKTEGLGNYSIHLVEVDTQGLSLKLLGTEASTCCPFP

SEQ ID NO: 32969 - protein, 120 aa, Homo sapiens
  Payload ID: 6476
  Gene Symbol: FUK
  Gene Name: fucokinase
  ENSP ID: ENSP00000458483
MEQPKGVDWTVIILTCQYKDSVQVFQRELEVRQKREQIPAGTLLLAVEDPEKRVGSGGATLNALLVAAEHLSARAGFTVVTSDVLHSAWILILHMGRDFPFDDCGRAFTCLPVENPEAPV

SEQ ID NO: 32970 - protein, 146 aa, Homo sapiens
  Payload ID: 6476
  Gene Symbol: FUK
  Gene Name: fucokinase
  ENSP ID: ENSP00000458622
MEQPKGVDWTVIILTCQYKDSVQVFQRELEVRQKREQIPAGTLLLAVEDPEKRVGSGGATLNALLVAAEHLSARAGFTVVTSDVLHSAWILILHMGRDFPFDDCGRAFTCLPVENPEAPVEALVCNLDCLLDIMTYRLGPGSPPGV

SEQ ID NO: 32971 - protein, 156 aa, Homo sapiens
  Payload ID: 6476
  Gene Symbol: FUK
  Gene Name: fucokinase
  ENSP ID: ENSP00000459168
MEQPKGVDWTVIILTCQYKDSVQVFQRELEVRQKREQIPAGTLLLAVEDPEKRVGSGGATLNALLVAAEHLSARAGFTVVTSDVLHSAWILILHMGRDFPFDDCGRAFTCLPVENPEAPVEALVCNLDCLLDIMTYRLGPGSPPGVWVCSTDMLLS

SEQ ID NO: 32972 - protein, 109 aa, Homo sapiens
  Payload ID: 6476
  Gene Symbol: FUK
  Gene Name: fucokinase
  ENSP ID: ENSP00000460484
MEQPKGVDWTVIILTCQYKDSVQVFQRELEVRQKREQIPAGTLLLAVEDPEKRVGSGGATLNALLVAAEHLSARAGFTVVTSDVLHSAWILILHMGRDFPFDDCGRAFT

SEQ ID NO: 32973 - protein, 575 aa, Homo sapiens
  Payload ID: 6476
  Gene Symbol: FUK
  Gene Name: fucokinase
  ENSP ID: ENSP00000462584
MLDHQEDGGEALRAWRASWRLSWEQLQPCLDRAATLASRRDLFFRQALHKARHVLEARQDLSLRPLIWAAVREGCPGPLLATLDQAGAGDPGVAARALACVADVLGCMAEGRGGLRSGPAANPEWMRPFSYLECGDLAAGVEALAQERDKWLSRPALLVRAARHYEGAGQILIRQAVMSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGALLKAAFICAGIVHVHSELQLSEQLLRTFGGGFELHTWSELPHGSGLGTSSILAGTALAALQRAAGRVVGTEALIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSLPLLGQCLTSYWEQKKLMAPGCEPLTVRRMMDVLAPHVHGQSLAGAGGGGFLYLLTKEPQQKEALEAVLAKTEGLGNYSIHLVEVDTQGLSLKLLGTEASTCCPFP

SEQ ID NO: 32974 - protein, 203 aa, Homo sapiens
  Payload ID: 6476
  Gene Symbol: FUK
  Gene Name: fucokinase
  ENSP ID: ENSP00000463088
EQVELPGPGQWVVAECPARVDFSGGWSDTPPLAYELGGAVLGLAVRVDGRRPIGARARRIPEPELWLAVGPRQDEMTVKIVCRCLADLRDYCQPHAPGALLKAAFICAGIVHVHSELQLSEQLLRTFGGGFELHTWSELPHGSGLGTSSILAGTALAALQRAAGRVVGTEALIHAVLHLEQVLTTVETGFHRVSQDGLDLLTS

SEQ ID NO: 32975 - protein, 154 aa, Homo sapiens
  Payload ID: 6477
  Gene Symbol: FUOM
  Gene Name: fucose mutarotase
  Uniprot ID: A2VDF0
  ENSP ID: ENSP00000278025
MVALKGVPALLSPELLYALARMGHGDEIVLADLNFPASSICQCGPMEIRADGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 32976 - protein, 109 aa, Homo sapiens
  Payload ID: 6477
  Gene Symbol: FUOM
  Gene Name: fucose mutarotase
  ENSP ID: ENSP00000357539
MEIRADGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 32977 - protein, 134 aa, Homo sapiens
  Payload ID: 6477
  Gene Symbol: FUOM
  Gene Name: fucose mutarotase
  Uniprot ID: A2VDF0
  ENSP ID: ENSP00000357540
MVALKGVPALLSPELLYALARMGHGDEIVLADLNFPASSICQCGPMEIRADGLGIPQLLEAVLKLLPLDTYVESPAAVMELVPSDKERGLQTPVWTEYESILRRAGCVRALAKIERFEFYERAKKAFAVVATGC

SEQ ID NO: 32978 - protein, 127 aa, Homo sapiens
  Payload ID: 6477
  Gene Symbol: FUOM
  Gene Name: fucose mutarotase
  ENSP ID: ENSP00000413379
KGVPALLSPELLYALARMGHGDEIGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 32979 - protein, 169 aa, Homo sapiens
  Payload ID: 6478
  Gene Symbol: FPGT
  Gene Name: fucose-1-phosphate guanylyltransferase
  Uniprot ID: O14772
  ENSP ID: ENSP00000359931
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSVSFQIYQNALAKHPVSFKAYWIQDVLWHLAQLWSIPDWGLMFQLGKTALLVVLTS

SEQ ID NO: 32980 - protein, 607 aa, Homo sapiens
  Payload ID: 6478
  Gene Symbol: FPGT
  Gene Name: fucose-1-phosphate guanylyltransferase
  ENSP ID: ENSP00000359935
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSGGYSQRLPNASALGKIFTALPLGNPIYQMLELKLAMYIDFPLNMNPGILVTCADDIELYSIGEFEFIRFDKPGFTALAHPSSLTIGTTHGVFVLDPFDDLKHRDLEYRSCHRFLHKPSIEKMYQFNAVCRPGNFCQQDFAGGDIADLKLDSDYVYTDSLFYMDHKSAKMLLAFYEKIGTLSCEIDAYGDFLQALGPGATVEYTRNTSNVIKEESELVEMRQRIFHLLKGTSLNVVVLNNSKFYHIGTTEEYLFYFTSDNSLKSELGLQSITFSIFPDIPECSGKTSCIIQSILDSRCSVAPGSVVEYSRLGPDVSVGENCIISGSYILTKAALPAHSFVCSLSLKMNRCLKYATMAFGVQDNLKKSVKTLSDIKLLQFFGVCFLSCLDVWNLKVTEELFSGNKTCLSLWTARIFPVCSSLSDSVITSLKMLNAVKNKSAFSLNSYKLLSIEEMLIYKDVEDMITYREQIFLEISLKSSLM

SEQ ID NO: 32981 - protein, 101 aa, Homo sapiens
  Payload ID: 6478
  Gene Symbol: FPGT
  Gene Name: fucose-1-phosphate guanylyltransferase
  ENSP ID: ENSP00000431733
MAAARDPPEVSLREATQRKLRRFSELRGKLVARGEFWDIVAITAADEKQELAYNQQLSEKLKRKELPLGVQYHVFVDPAGAKIVETGFHHVSQDGLYLLTS

SEQ ID NO: 32982 - protein, 340 aa, Homo sapiens
  Payload ID: 6478
  Gene Symbol: FPGT
  Gene Name: fucose-1-phosphate guanylyltransferase
  Uniprot ID: O14772
  ENSP ID: ENSP00000432819
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSGGYSQRLPNASALGKIFTALPLDIPECSGKTSCIIQSILDSRCSVAPGSVVEYSRLGPDVSVGENCIISGSYILTKAALPAHSFVCSLSLKMNRCLKYATMAFGVQDNLKKSVKTLSDIKLLQFFGVCFLSCLDVWNLKVTEELFSGNKTCLSLWTARIFPVCSSLSDSVITSLKMLNAVKNKSAFSLNSYKLLSIEEMLIYKDVEDMITYREQIFLEISLKSSLM

SEQ ID NO: 32983 - protein, 137 aa, Homo sapiens
  Payload ID: 6478
  Gene Symbol: FPGT
  Gene Name: fucose-1-phosphate guanylyltransferase
  ENSP ID: ENSP00000433044
MAAARDPPEVSLREATQRKLRRFSELRGTREGTGVLLGNAEGGCFYVPGGKLVARGEFWDIVAITAADEKQELAYNQQLSEKLKRKELPLGVQYHVFVDPAGAKIGTRFMEMEDQHFVPFNVWKSYMEINGILLPSY

SEQ ID NO: 32984 - protein, 174 aa, Homo sapiens
  Payload ID: 6478
  Gene Symbol: FPGT
  Gene Name: fucose-1-phosphate guanylyltransferase
  ENSP ID: ENSP00000433499
ELRGTREGTGVLLGNAEGGCFYVPGGKLVARGEFWDIVAITAADEKQELAYNQQLSEKLKRKELPLGVQYHVFVDPAGAKIGNGGSTLCALQCLEKLYGDKWNSFTILLIHSGGYSQRLPNASALGKIFTALPLGNPIYQMLELKLAMYIDFPLNMNPGILVTCADDIELYSIG

SEQ ID NO: 32985 - protein, 128 aa, Homo sapiens
  Payload ID: 6478
  Gene Symbol: FPGT
  Gene Name: fucose-1-phosphate guanylyltransferase
  ENSP ID: ENSP00000434934
MRAVRRGLREGGAMAAARDPPEVSLREATQRKLRRFSELRGKLVARGEFWDIVAITAADEKQELAYNQQLSEKLKRKELPLGVQYHVFVDPAGAKIGTRFMEMEDQHFVPFNVWKSYMEINGILLPSY

SEQ ID NO: 32986 - protein, 466 aa, Homo sapiens
  Payload ID: 6479
  Gene Symbol: FUCA1
  Gene Name: fucosidase, alpha-L- 1, tissue
  Uniprot ID: P04066
  ENSP ID: ENSP00000363603
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 32987 - protein, 467 aa, Homo sapiens
  Payload ID: 6480
  Gene Symbol: FUCA2
  Gene Name: fucosidase, alpha-L- 2, plasma
  Uniprot ID: Q9BTY2
  ENSP ID: ENSP00000002165
MRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEGFTLWGSEYSWNWNAIDEGPKRDIVKELEVAIRNRTDLRFGLYYSLFEWFHPLFLEDESSSFHKRQFPVSKTLPELYELVNNYQPEVLWSDGDGGAPDQYWNSTGFLAWLYNESPVRGTVVTNDRWGAGSICKHGGFYTCSDRYNPGHLLPHKWENCMTIDKLSWGYRREAGISDYLTIEELVKQLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVKLLGHGQPLNWISLEQNGIMVELPQLTIHQMPCKWGWALALTNVI

SEQ ID NO: 32988 - protein, 109 aa, Homo sapiens
  Payload ID: 6480
  Gene Symbol: FUCA2
  Gene Name: fucosidase, alpha-L- 2, plasma
  ENSP ID: ENSP00000398119
QLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVRGNFTLFL

SEQ ID NO: 32989 - protein, 365 aa, Homo sapiens
  Payload ID: 6481
  Gene Symbol: FUT1
  Gene Name: fucosyltransferase 1 (galactoside 2-alpha-L-fucosyltransferase, H blood group)
  Uniprot ID: P19526
  ENSP ID: ENSP00000312021
MWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 32990 - protein, 479 aa, Homo sapiens
  Payload ID: 6482
  Gene Symbol: FUT10
  Gene Name: fucosyltransferase 10 (alpha (1,3) fucosyltransferase)
  Uniprot ID: Q6P4F1
  ENSP ID: ENSP00000332757
MVRIQRRKLLASCLCVTATVFLLVTLQVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 32991 - protein, 451 aa, Homo sapiens
  Payload ID: 6482
  Gene Symbol: FUT10
  Gene Name: fucosyltransferase 10 (alpha (1,3) fucosyltransferase)
  Uniprot ID: Q6P4F1
  ENSP ID: ENSP00000429870
MVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 32992 - protein, 451 aa, Homo sapiens; identical to SEQ ID NO: 32991
  Payload ID: 6482
  Gene Symbol: FUT10
  Gene Name: fucosyltransferase 10 (alpha (1,3) fucosyltransferase)
  Uniprot ID: Q6P4F1
  ENSP ID: ENSP00000430428

SEQ ID NO: 32993 - protein, 492 aa, Homo sapiens
  Payload ID: 6483
  Gene Symbol: FUT11
  Gene Name: fucosyltransferase 11 (alpha (1,3) fucosyltransferase)
  Uniprot ID: Q495W5
  ENSP ID: ENSP00000361932
MAAGPIRVVLVLLGVLSVCAASGHGSVAEREAGGEAEWAEPWDGAVFRPPSALGAVGVTRSSGTPRPGREEAGDLPVLLWWSPGLFPHFPGDSERIECARGACVASRNRRALRDSRTRALLFYGTDFRASAAPLPRLAHQSWALLHEESPLNNFLLSHGPGIRLFNLTSTFSRHSDYPLSLQWLPGTAYLRRPVPPPMERAEWRRRGYAPLLYLQSHCDVPADRDRYVRELMRHIPVDSYGKCLQNRELPTARLQDTATATTEDPELLAFLSRYKFHLALENAICNDYMTEKLWRPMHLGAVPVYRGSPSVRDWMPNNHSVILIDDFESPQKLAEFIDFLDKNDEEYMKYLAYKQPGGITNQFLLDSLKHREWGVNDPLLPNYLNGFECFVCDYELARLDAEKAHAASPGDSPVFEPHIAQPSHMDCPVPTPGFGNVEEIPENDSWKEMWLQDYWQGLDQGEALTAMIHNNETEQTKFWDYLHEIFMKRQHL

SEQ ID NO: 32994 - protein, 476 aa, Homo sapiens
  Payload ID: 6483
  Gene Symbol: FUT11
  Gene Name: fucosyltransferase 11 (alpha (1,3) fucosyltransferase)
  Uniprot ID: Q495W5
  ENSP ID: ENSP00000378270
MAAGPIRVVLVLLGVLSVCAASGHGSVAEREAGGEAEWAEPWDGAVFRPPSALGAVGVTRSSGTPRPGREEAGDLPVLLWWSPGLFPHFPGDSERIECARGACVASRNRRALRDSRTRALLFYGTDFRASAAPLPRLAHQSWALLHEESPLNNFLLSHGPGIRLFNLTSTFSRHSDYPLSLQWLPGTAYLRRPVPPPMERAEWRRRGYAPLLYLQSHCDVPADRDRYVRELMRHIPVDSYGKCLQNRELPTARLQDTATATTEDPELLAFLSRYKFHLALENAICNDYMTEKLWRPMHLGAVPVYRGSPSVRDWMPNNHSVILIDDFESPQKLAEFIDFLDKNDEEYMKYLAYKQPGGITNQFLLDSLKHREWGVNDPLLPNYLNGFECFVCDYELARLDAEKAHAASPGDSPVFEPHIAQPSHMDCPVPTPGFGNVEEIPENDSSLVQVRDHCICLRFLWPHSEKGRTHNYAAVP

SEQ ID NO: 32995 - protein, 343 aa, Homo sapiens
  Payload ID: 6484
  Gene Symbol: FUT2
  Gene Name: fucosyltransferase 2 (secretor status included)
  Uniprot ID: Q10981
  ENSP ID: ENSP00000375748
MLVVQMPFSFPMAHFILFVFTVSTIFHVQQRLAKIQAMWELPVQIPVLASTSKALGPSQLRGMWTINAIGRLGNQMGEYATLYALAKMNGRPAFIPAQMHSTLAPIFRITLPVLHSATASRIPWQNYHLNDWMEEEYRHIPGEYVRFTGYPCSWTFYHHLRQEILQEFTLHDHVREEAQKFLRGLQVNGSRPGTFVGVHVRRGDYVHVMPKVWKGVVADRRYLQQALDWFRARYSSLIFVVTSNGMAWCRENIDTSHGDVVFAGDGIEGSPAKDFALLTQCNHTIMTIGTFGIWAAYLTGGDTIYLANYTLPDSPFLKIFKPEAAFLPEWTGIAADLSPLLKH

SEQ ID NO: 32996 - protein, 343 aa, Homo sapiens; identical to SEQ ID NO: 32995
  Payload ID: 6484
  Gene Symbol: FUT2
  Gene Name: fucosyltransferase 2 (secretor status included)
  Uniprot ID: Q10981
  ENSP ID: ENSP00000387498

SEQ ID NO: 32997 - protein, 220 aa, Homo sapiens
  Payload ID: 6484
  Gene Symbol: FUT2
  Gene Name: fucosyltransferase 2 (secretor status included)
  ENSP ID: ENSP00000430227
MLVVQMPFSFPMAHFILFVFTVSTIFHVQQRLAKIQAMWELPVQIPVLASTSKALGPSQLRGMWTINAIGRLGNQMGEYATLYALAKMNGRPAFIPAQMHSTLAPIFRITLPVLHSATASRIPWQNYHLNDWMEEEYRHIPGEYVRFTGYPCSWTFYHHLRQEILQEFTLHDHVREEAQKFLRGLQVNGSRPGTFVGVHVRRGDYVHVMPKVWKGVVADR

SEQ ID NO: 32998 - protein, 361 aa, Homo sapiens
  Payload ID: 6485
  Gene Symbol: FUT3
  Gene Name: fucosyltransferase 3 (galactoside 3(4)-L-fucosyltransferase, Lewis blood group)
  Uniprot ID: P21217
  ENSP ID: ENSP00000305603
MDPLGAAKPQWPWRRCLAALLFQLLVAVCFFSYLRVSRDDATGSPRAPSGSSRQDTTPTRPTLLILLRTWPFHIPVALSRCSEMVPGTADCHITADRKVYPQADMVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 32999 - protein, 361 aa, Homo sapiens; identical to SEQ ID NO: 32998
  Payload ID: 6485
  Gene Symbol: FUT3
  Gene Name: fucosyltransferase 3 (galactoside 3(4)-L-fucosyltransferase, Lewis blood group)
  Uniprot ID: P21217
  ENSP ID: ENSP00000416443

SEQ ID NO: 33000 - protein, 361 aa, Homo sapiens; identical to SEQ ID NO: 32998
  Payload ID: 6485
  Gene Symbol: FUT3
  Gene Name: fucosyltransferase 3 (galactoside 3(4)-L-fucosyltransferase, Lewis blood group)
  Uniprot ID: P21217
  ENSP ID: ENSP00000465804

SEQ ID NO: 33001 - protein, 107 aa, Homo sapiens
  Payload ID: 6485
  Gene Symbol: FUT3
  Gene Name: fucosyltransferase 3 (galactoside 3(4)-L-fucosyltransferase, Lewis blood group)
  ENSP ID: ENSP00000467081
MDPLGAAKPQWPWRRCLAALLFQLLVAVCFFSYLRVSRDDATGSPRAPSGSSRQDTTPTRPTLLILLRTWPFHIPVALSRCSEMVPGTADCHITADRKVYPQADMVI

SEQ ID NO: 33002 - protein, 44 aa, Homo sapiens
  Payload ID: 6485
  Gene Symbol: FUT3
  Gene Name: fucosyltransferase 3 (galactoside 3(4)-L-fucosyltransferase, Lewis blood group)
  ENSP ID: ENSP00000467633
MDPLGAAKPQWPWRRCLAALLFQLLVAVCFFSYLRVSRDDATGS

SEQ ID NO: 33003 - protein, 361 aa, Homo sapiens; identical to SEQ ID NO: 32998
  Payload ID: 6485
  Gene Symbol: FUT3
  Gene Name: fucosyltransferase 3 (galactoside 3(4)-L-fucosyltransferase, Lewis blood group)
  Uniprot ID: P21217
  ENSP ID: ENSP00000468123

SEQ ID NO: 33004 - protein, 100 aa, Homo sapiens
  Payload ID: 6485
  Gene Symbol: FUT3
  Gene Name: fucosyltransferase 3 (galactoside 3(4)-L-fucosyltransferase, Lewis blood group)
  ENSP ID: ENSP00000468515
MDPLGAAKPQWPWRRCLAALLFQLLVAVCFFSYLRVSRDDATGSPRAPSGSSRQDTTPTRPTLLILLRTWPFHIPVALSRCSEMVPGTADCHITADRKVY

SEQ ID NO: 33005 - protein, 4 aa, Homo sapiens
  Payload ID: 6485
  Gene Symbol: FUT3
  Gene Name: fucosyltransferase 3 (galactoside 3(4)-L-fucosyltransferase, Lewis blood group)
  ENSP ID: ENSP00000468795
MDPL

SEQ ID NO: 33006 - protein, 530 aa, Homo sapiens
  Payload ID: 6486
  Gene Symbol: FUT4
  Gene Name: fucosyltransferase 4 (alpha (1,3) fucosyltransferase, myeloid-specific)
  Uniprot ID: P22083
  ENSP ID: ENSP00000351602
MRRLWGAARKPSGAGWEKEWAEAPQEAPGAWSGRLGPGRSGRKGRAVPGWASWPAHLALAARPARHLGGAGQGPRPLHSGTAPFHSRASGERQRRLEPQLQHESRCRSSTPADAWRAEAALPVRAMGAPWGSPTAAAGGRRGWRRGRGLPWTVCVLAAAGLTCTALITYACWGQLPPLPWASPTPSRPVGVLLWWEPFGGRDSAPRPPPDCRLRFNISGCRLLTDRASYGEAQAVLFHHRDLVKGPPDWPPPWGIQAHTAEEVDLRVLDYEEAAAAAEALATSSPRPPGQRWVWMNFESPSHSPGLRSLASNLFNWTLSYRADSDVFVPYGYLYPRSHPGDPPSGLAPPLSRKQGLVAWVVSHWDERQARVRYYHQLSQHVTVDVFGRGGPGQPVPEIGLLHTVARYKFYLAFENSQHLDYITEKLWRNALLAGAVPVVLGPDRANYERFVPRGAFIHVDDFPSASSLASYLLFLDRNPAVYRRYFHWRRSYAVHITSFWDEPWCRVCQAVQRAGDRPKSIRNLASWFER

SEQ ID NO: 33007 - protein, 374 aa, Homo sapiens
  Payload ID: 6487
  Gene Symbol: FUT5
  Gene Name: fucosyltransferase 5 (alpha (1,3) fucosyltransferase)
  Uniprot ID: Q11128
  ENSP ID: ENSP00000252675
MDPLGPAKPQWLWRRCLAGLLFQLLVAVCFFSYLRVSRDDATGSPRPGLMAVEPVTGAPNGSRCQDSMATPAHPTLLILLWTWPFNTPVALPRCSEMVPGAADCNITADSSVYPQADAVIVHHWDIMYNPSANLPPPTRPQGQRWIWFSMESPSNCRHLEALDGYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFHWRETLRPRSFSWALAFCKACWKLQQESRYQTVRSIAAWFT

SEQ ID NO: 33008 - protein, 374 aa, Homo sapiens; identical to SEQ ID NO: 33007
  Payload ID: 6487
  Gene Symbol: FUT5
  Gene Name: fucosyltransferase 5 (alpha (1,3) fucosyltransferase)
  ENSP ID: ENSP00000466880

SEQ ID NO: 33009 - protein, 359 aa, Homo sapiens
  Payload ID: 6488
  Gene Symbol: FUT6
  Gene Name: fucosyltransferase 6 (alpha (1,3) fucosyltransferase)
  Uniprot ID: P51993
  ENSP ID: ENSP00000286955
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQEESRYQTRGIAAWFT

SEQ ID NO: 33010 - protein, 359 aa, Homo sapiens; identical to SEQ ID NO: 33009
  Payload ID: 6488
  Gene Symbol: FUT6
  Gene Name: fucosyltransferase 6 (alpha (1,3) fucosyltransferase)
  Uniprot ID: P51993
  ENSP ID: ENSP00000313398

SEQ ID NO: 33011 - protein, 359 aa, Homo sapiens; identical to SEQ ID NO: 33009
  Payload ID: 6488
  Gene Symbol: FUT6
  Gene Name: fucosyltransferase 6 (alpha (1,3) fucosyltransferase)
  Uniprot ID: P51993
  ENSP ID: ENSP00000431708

SEQ ID NO: 33012 - protein, 44 aa, Homo sapiens
  Payload ID: 6488
  Gene Symbol: FUT6
  Gene Name: fucosyltransferase 6 (alpha (1,3) fucosyltransferase)
  ENSP ID: ENSP00000431880
MDPLGPAKPQWSWRCCLTTLLFQLLMAVCFFSYLRVSQDDPTVY

SEQ ID NO: 33013 - protein, 69 aa, Homo sapiens
  Payload ID: 6488
  Gene Symbol: FUT6
  Gene Name: fucosyltransferase 6 (alpha (1,3) fucosyltransferase)
  ENSP ID: ENSP00000432161
MDPLGPAKPQWSWRCCLTTLLFQLLMAVCFFSYLRVSQDDPTVYPNGSRFPDSTGTPAHSIPLILLWTW

SEQ ID NO: 33014 - protein, 359 aa, Homo sapiens; identical to SEQ ID NO: 33009
  Payload ID: 6488
  Gene Symbol: FUT6
  Gene Name: fucosyltransferase 6 (alpha (1,3) fucosyltransferase)
  Uniprot ID: P51993
  ENSP ID: ENSP00000432954

SEQ ID NO: 33015 - protein, 30 aa, Homo sapiens
  Payload ID: 6488
  Gene Symbol: FUT6
  Gene Name: fucosyltransferase 6 (alpha (1,3) fucosyltransferase)
  ENSP ID: ENSP00000433811
MDPLGPAKPQWSWRCCLTTLLFQLLMAVCF

SEQ ID NO: 33016 - protein, 66 aa, Homo sapiens
  Payload ID: 6488
  Gene Symbol: FUT6
  Gene Name: fucosyltransferase 6 (alpha (1,3) fucosyltransferase)
  ENSP ID: ENSP00000436413
MDPLGPAKPQWSWRCCLTTLLFQLLMAVCFFSYLRVSQDDPTVYPNGSRFPDSTGTPAHSIPLILL

SEQ ID NO: 33017 - protein, 137 aa, Homo sapiens
  Payload ID: 6488
  Gene Symbol: FUT6
  Gene Name: fucosyltransferase 6 (alpha (1,3) fucosyltransferase)
  ENSP ID: ENSP00000436547
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSME

SEQ ID NO: 33018 - protein, 364 aa, Homo sapiens
  Payload ID: 6488
  Gene Symbol: FUT6
  Gene Name: fucosyltransferase 6 (alpha (1,3) fucosyltransferase)
  Uniprot ID: P51993
  ENSP ID: ENSP00000466016
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQEESSGGLIYLRTRLPEASPA

SEQ ID NO: 33019 - protein, 342 aa, Homo sapiens
  Payload ID: 6489
  Gene Symbol: FUT7
  Gene Name: fucosyltransferase 7 (alpha (1,3) fucosyltransferase)
  Uniprot ID: Q11130
  ENSP ID: ENSP00000318142
MNNAGHGPTRRLRGLGVLAGVALLAALWLLWLLGSAPRGTPAPQPTITILVWHWPFTDQPPELPSDTCTRYGIARCHLSANRSLLASADAVVFHHRELQTRRSHLPLAQRPRGQPWVWASMESPSHTHGLSHLRGIFNWVLSYRRDSDIFVPYGRLEPHWGPSPPLPAKSRVAAWVVSNFQERQLRARLYRQLAPHLRVDVFGRANGRPLCASCLVPTVAQYRFYLSFENSQHRDYITEKFWRNALVAGTVPVVLGPPRATYEAFVPADAFVHVDDFGSARELAAFLTGMNESRYQRFFAWRDRLRVRLFTDWRERFCAICDRYPHLPRSQVYEDLEGWFQA

SEQ ID NO: 33020 - protein, 308 aa, Homo sapiens
  Payload ID: 6490
  Gene Symbol: FUT8
  Gene Name: fucosyltransferase 8 (alpha (1,6) fucosyltransferase)
  Uniprot ID: Q9BYC5
  ENSP ID: ENSP00000345865
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGTPIMNLLVITLFPGQLDCTIDTQKIHFVE

SEQ ID NO: 33021 - protein, 446 aa, Homo sapiens
  Payload ID: 6490
  Gene Symbol: FUT8
  Gene Name: fucosyltransferase 8 (alpha (1,6) fucosyltransferase)
  ENSP ID: ENSP00000351057
MAITVSLVNNKRKIVVLAQPTTVKRKRITPYKSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 33022 - protein, 575 aa, Homo sapiens
  Payload ID: 6490
  Gene Symbol: FUT8
  Gene Name: fucosyltransferase 8 (alpha (1,6) fucosyltransferase)
  Uniprot ID: Q9BYC5
  ENSP ID: ENSP00000353910
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 33023 - protein, 575 aa, Homo sapiens; identical to SEQ ID NO: 33022
  Payload ID: 6490
  Gene Symbol: FUT8
  Gene Name: fucosyltransferase 8 (alpha (1,6) fucosyltransferase)
  Uniprot ID: Q9BYC5
  ENSP ID: ENSP00000378087

SEQ ID NO: 33024 - protein, 15 aa, Homo sapiens
  Payload ID: 6490
  Gene Symbol: FUT8
  Gene Name: fucosyltransferase 8 (alpha (1,6) fucosyltransferase)
  ENSP ID: ENSP00000451577
MRPWTGSWRWIMLIL

SEQ ID NO: 33025 - protein, 40 aa, Homo sapiens
  Payload ID: 6490
  Gene Symbol: FUT8
  Gene Name: fucosyltransferase 8 (alpha (1,6) fucosyltransferase)
  ENSP ID: ENSP00000451689
MRPWTGSWRWIMLILFAWGTLLFYIGGHLVRDNDHPDHSS

SEQ ID NO: 33026 - protein, 50 aa, Homo sapiens
  Payload ID: 6490
  Gene Symbol: FUT8
  Gene Name: fucosyltransferase 8 (alpha (1,6) fucosyltransferase)
  ENSP ID: ENSP00000452105
MRPWTGSWRWIMLILFAWGTLLFYIGGHLVRDNDHPDHSSRELSKILAKL

SEQ ID NO: 33027 - protein, 46 aa, Homo sapiens
  Payload ID: 6490
  Gene Symbol: FUT8
  Gene Name: fucosyltransferase 8 (alpha (1,6) fucosyltransferase)
  ENSP ID: ENSP00000452147
MRPWTGSWRWIMLILFAWGTLLFYIGGHLVRDNDHPDHSSRELSKI

SEQ ID NO: 33028 - protein, 44 aa, Homo sapiens
  Payload ID: 6490
  Gene Symbol: FUT8
  Gene Name: fucosyltransferase 8 (alpha (1,6) fucosyltransferase)
  ENSP ID: ENSP00000452309
MRPWTGSWRWIMLILFAWGTLLFYIGGHLVRDNDHPDHSSRELS

SEQ ID NO: 33029 - protein, 412 aa, Homo sapiens
  Payload ID: 6490
  Gene Symbol: FUT8
  Gene Name: fucosyltransferase 8 (alpha (1,6) fucosyltransferase)
  Uniprot ID: Q9BYC5
  ENSP ID: ENSP00000452433
MTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 33030 - protein, 29 aa, Homo sapiens
  Payload ID: 6490
  Gene Symbol: FUT8
  Gene Name: fucosyltransferase 8 (alpha (1,6) fucosyltransferase)
  ENSP ID: ENSP00000452597
MRPWTGSWRWIMLILFAWGTLLFYIGGHL

SEQ ID NO: 33031 - protein, 359 aa, Homo sapiens
  Payload ID: 6491
  Gene Symbol: FUT9
  Gene Name: fucosyltransferase 9 (alpha (1,3) fucosyltransferase)
  Uniprot ID: Q9Y231
  ENSP ID: ENSP00000302599
MTSTSKGILRPFLIVCIILGCFMACLLIYIKPTNSWIFSPMESASSVLKMKNFFSTKTDYFNETTILVWVWPFGQTFDLTSCQAMFNIQGCHLTTDRSLYNKSHAVLIHHRDISWDLTNLPQQARPPFQKWIWMNLESPTHTPQKSGIEHLFNLTLTYRRDSDIQVPYGFLTVSTNPFVFEVPSKEKLVCWVVSNWNPEHARVKYYNELSKSIEIHTYGQAFGEYVNDKNLIPTISTCKFYLSFENSIHKDYITEKLYNAFLAGSVPVVLGPSRENYENYIPADSFIHVEDYNSPSELAKYLKEVDKNNKLYLSYFNWRKDFTVNLPRFWESHACLACDHVKRHQEYKSVGNLEKWFWN

SEQ ID NO: 33032 - protein, 461 aa, Homo sapiens
  Payload ID: 6492
  Gene Symbol: FKTN
  Gene Name: fukutin
  Uniprot ID: O75072
  ENSP ID: ENSP00000223528
MSRINKNVVLALLTLTSSAFLLFQLYYYKHYLSTKNGAGLSKSKGSRIGFDSTQWRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFRKLQFGRYPGAFDRPELQQVTVDGLEVLIPKDPMHFVEEVPHSRFIECRYKEARAFFQQYLDDNTVEAVAFRKSAKELLQLAAKTLNKLGVPFWLSSGTCLGWYRQCNIIPYSKDVDLGIFIQDYKSDIILAFQDAGLPLKHKFGKVEDSLELSFQGKDDVKLDVFFFYEETDHMWNGGTQAKTGKKFKYLFPKFTLCWTEFVDMKVHVPCETLEYIEANYGKTWKIPVKTWDWKRSPPNVQPNGIWPISEWDEVIQLY

SEQ ID NO: 33033 - protein, 430 aa, Homo sapiens
  Payload ID: 6492
  Gene Symbol: FKTN
  Gene Name: fukutin
  Uniprot ID: O75072
  ENSP ID: ENSP00000350687
MSRINKNVVLALLTLTSSAFLLFQLYYYKHYLSTKNGAGLSKSKGSRIGFDSTQWRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFRKLQFGRYPGAFDRPELQQVTVDGLEVLIPKDPMHFVEEVPHSRFIECRYKEARAFFQQYLDDNTVEAVAFRKSAKELLQLAAKTLNKLGVPFWLSSGTCLGWYRQCNIIPYSKDVDLGIFIQDYKSDIILAFQDAGLPLKHKFGKVEDSLELSFQGKDDVKLDVFFFYEETDHMWNGGTQAKTGKKFKYLFPKFTLCWTEFVDMKVHVPCETLEYIEANYGKNQQGA

SEQ ID NO: 33034 - protein, 235 aa, Homo sapiens
  Payload ID: 6492
  Gene Symbol: FKTN
  Gene Name: fukutin
  ENSP ID: ENSP00000363837
MILEVGENNGFFSKSLLPRYASKKLKSSLPHSRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFRKLQFGRYPGAFDRPELQQVTVDGLEVLIPKDPMHFVEEVPHSRFIECRYKEARAF

SEQ ID NO: 33035 - protein, 430 aa, Homo sapiens; identical to SEQ ID NO: 33033
  Payload ID: 6492
  Gene Symbol: FKTN
  Gene Name: fukutin
  Uniprot ID: O75072
  ENSP ID: ENSP00000399140

SEQ ID NO: 33036 - protein, 160 aa, Homo sapiens
  Payload ID: 6492
  Gene Symbol: FKTN
  Gene Name: fukutin
  ENSP ID: ENSP00000414114
  MOD_RES (1)..(1): Any amino acid
XWYRQCNIIPYSKDVDLGIFIQDYKSDIILAFQDAGLPLKHKFGKVEDSLELSFQGKDDVKLDVFFFYEETDHMWNGGTQAKTGKKFKYLFPKFTLCWTEFVDMKVHVPCETLEYIEANYGKEAESYILSMLFRTTFWSLADFPLTPENNSSLKNGNLNV

SEQ ID NO: 33037 - protein, 67 aa, Homo sapiens
  Payload ID: 6492
  Gene Symbol: FKTN
  Gene Name: fukutin
  ENSP ID: ENSP00000473347
MSRINKNVVLALLTLTSSAFLLFQLYYYKHYLSTKNGAGLSKSKGSRIGFDSTQWHISPYIENVHLS

SEQ ID NO: 33038 - protein, 461 aa, Homo sapiens; identical to SEQ ID NO: 33032
  Payload ID: 6492
  Gene Symbol: FKTN
  Gene Name: fukutin
  Uniprot ID: O75072
  ENSP ID: ENSP00000473540

SEQ ID NO: 33039 - protein, 495 aa, Homo sapiens
  Payload ID: 6493
  Gene Symbol: FKRP
  Gene Name: fukutin related protein
  Uniprot ID: Q9H9S5
  ENSP ID: ENSP00000326570
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRLALLQPALDRPAAASRPETYVATEFVALVPDGARAEAPGLLERMVEALRAGSARLVAAPVATANPARCLALNVSLREWTARYGAAPAAPRCDALDGDAVVLLRARDLFNLSAPLARPVGTSLFLQTALRGWAVQLLDLTFAAARQPPLATAHARWKAEREGRARRAALLRALGIRLVSWEGGRLEWFGCNKETTRCFGTVVGDTPAYLYEERWTPPCCLRALRETARYVVGVLEAAGVRYWLEGGSLLGAARHGDIIPWDYDVDLGIYLEDVGNCEQLRGAEAGSVVDERGFVWEKAVEGDFFRVQYSESNHLHVDLWPFYPRNGVMTKDTWLDHRQDVEFPEHFLQPLVPLPFAGFVAQAPNNYRRFLELKFGPGVIENPQYPNPALLSLTGSG

SEQ ID NO: 33040 - protein, 495 aa, Homo sapiens; identical to SEQ ID NO: 33039
  Payload ID: 6493
  Gene Symbol: FKRP
  Gene Name: fukutin related protein
  Uniprot ID: Q9H9S5
  ENSP ID: ENSP00000375776

SEQ ID NO: 33041 - protein, 106 aa, Homo sapiens
  Payload ID: 6493
  Gene Symbol: FKRP
  Gene Name: fukutin related protein
  ENSP ID: ENSP00000468825
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRLALLQP

SEQ ID NO: 33042 - protein, 68 aa, Homo sapiens
  Payload ID: 6493
  Gene Symbol: FKRP
  Gene Name: fukutin related protein
  ENSP ID: ENSP00000469373
MRLTRCQAALAAAITLNLLVLFYVSWLQHQPRNSRARGPRRASAAGPRVTVLVREFEAFDNAVPELVD

SEQ ID NO: 33043 - protein, 72 aa, Homo sapiens
  Payload ID: 6493
  Gene Symbol: FKRP
  Gene Name: fukutin related protein
  ENSP ID: ENSP00000470024
MRLTRCQAALAAAITLNLLVLFYVSWLQHQPRNSRARGPRRASAAGPRVTVLVREFEAFDNAVPELVDSFLQ

SEQ ID NO: 33044 - protein, 80 aa, Homo sapiens
  Payload ID: 6493
  Gene Symbol: FKRP
  Gene Name: fukutin related protein
  ENSP ID: ENSP00000470096
MRLTRCQAALAAAITLNLLVLFYVSWLQHQPRNSRARGPRRASAAGPRVTVLVREFEAFDNAVPELVDSFLQQDPAQPVV

SEQ ID NO: 33045 - protein, 162 aa, Homo sapiens
  Payload ID: 6493
  Gene Symbol: FKRP
  Gene Name: fukutin related protein
  ENSP ID: ENSP00000470103
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRLALLQPALDRPAAASRPETYVATEFVALVPDGARAEAPGLLERMVEALRAGSARLVAAPVAT

SEQ ID NO: 33046 - protein, 86 aa, Homo sapiens
  Payload ID: 6493
  Gene Symbol: FKRP
  Gene Name: fukutin related protein
  ENSP ID: ENSP00000470297
MRLTRCQAALAAAITLNLLVLFYVSWLQHQPRNSRARGPRRASAAGPRVTVLVREFEAFDNAVPELVDSFLQQDPAQPVVVAADTL

SEQ ID NO: 33047 - protein, 114 aa, Homo sapiens
  Payload ID: 6493
  Gene Symbol: FKRP
  Gene Name: fukutin related protein
  ENSP ID: ENSP00000470335
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRLALLQPALDRPAAA

SEQ ID NO: 33048 - protein, 137 aa, Homo sapiens
  Payload ID: 6493
  Gene Symbol: FKRP
  Gene Name: fukutin related protein
  ENSP ID: ENSP00000470901
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRLALLQPALDRPAAASRPETYVATEFVALVPDGARAEA

SEQ ID NO: 33049 - protein, 61 aa, Homo sapiens
  Payload ID: 6493
  Gene Symbol: FKRP
  Gene Name: fukutin related protein
  ENSP ID: ENSP00000470929
MRLTRCQAALAAAITLNLLVLFYVSWLQHQPRNSRARGPRRASAAGPRVTVLVREFEAFDN

SEQ ID NO: 33050 - protein, 29 aa, Homo sapiens
  Payload ID: 6493
  Gene Symbol: FKRP
  Gene Name: fukutin related protein
  ENSP ID: ENSP00000471088
MRLTRCQAALAAAITLNLLVLFYVSWLQH

SEQ ID NO: 33051 - protein, 101 aa, Homo sapiens
  Payload ID: 6493
  Gene Symbol: FKRP
  Gene Name: fukutin related protein
  ENSP ID: ENSP00000471209
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRL

SEQ ID NO: 33052 - protein, 70 aa, Homo sapiens
  Payload ID: 6493
  Gene Symbol: FKRP
  Gene Name: fukutin related protein
  ENSP ID: ENSP00000471573
MRLTRCQAALAAAITLNLLVLFYVSWLQHQPRNSRARGPRRASAAGPRVTVLVREFEAFDNAVPELVDSF

SEQ ID NO: 33053 - protein, 35 aa, Homo sapiens
  Payload ID: 6493
  Gene Symbol: FKRP
  Gene Name: fukutin related protein
  ENSP ID: ENSP00000471971
MVEALRAGSARLVAAPVATANPARCLALNVSLREW

SEQ ID NO: 33054 - protein, 59 aa, Homo sapiens
  Payload ID: 6493
  Gene Symbol: FKRP
  Gene Name: fukutin related protein
  ENSP ID: ENSP00000472370
MRLTRCQAALAAAITLNLLVLFYVSWLQHQPRNSRARGPRRASAAGPRVTVLVREFEAF

SEQ ID NO: 33055 - protein, 53 aa, Homo sapiens
  Payload ID: 6493
  Gene Symbol: FKRP
  Gene Name: fukutin related protein
  ENSP ID: ENSP00000472807
MRLTRCQAALAAAITLNLLVLFYVSWLQHQPRNSRARGPRRASAAGPRVTVLV

SEQ ID NO: 33056 - protein, 4 aa, Homo sapiens
  Payload ID: 6493
  Gene Symbol: FKRP
  Gene Name: fukutin related protein
  ENSP ID: ENSP00000472850
MRLT

SEQ ID NO: 33057 - protein, 95 aa, Homo sapiens
  Payload ID: 6493
  Gene Symbol: FKRP
  Gene Name: fukutin related protein
  ENSP ID: ENSP00000472981
MRLTRCQAALAAAITLNLLVLFYVSWLQHQPRNSRARGPRRASAAGPRVTVLVREFEAFDNAVPELVDSFLQQDPAQPVVVAADTLPYPPLALPR

SEQ ID NO: 33058 - protein, 510 aa, Homo sapiens
  Payload ID: 6494
  Gene Symbol: FH
  Gene Name: fumarate hydratase
  Uniprot ID: P07954
  ENSP ID: ENSP00000355518
MYRALRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 33059 - protein, 419 aa, Homo sapiens
  Payload ID: 6495
  Gene Symbol: FAH
  Gene Name: fumarylacetoacetate hydrolase (fumarylacetoacetase)
  Uniprot ID: P16930
  ENSP ID: ENSP00000261755
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 33060 - protein, 419 aa, Homo sapiens; identical to SEQ ID NO: 33059
  Payload ID: 6495
  Gene Symbol: FAH
  Gene Name: fumarylacetoacetate hydrolase (fumarylacetoacetase)
  Uniprot ID: P16930
  ENSP ID: ENSP00000385080

SEQ ID NO: 33061 - protein, 161 aa, Homo sapiens
  Payload ID: 6495
  Gene Symbol: FAH
  Gene Name: fumarylacetoacetate hydrolase (fumarylacetoacetase)
  ENSP ID: ENSP00000453152
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHG

SEQ ID NO: 33062 - protein, 419 aa, Homo sapiens; identical to SEQ ID NO: 33059
  Payload ID: 6495
  Gene Symbol: FAH
  Gene Name: fumarylacetoacetate hydrolase (fumarylacetoacetase)
  Uniprot ID: P16930
  ENSP ID: ENSP00000453347

SEQ ID NO: 33063 - protein, 349 aa, Homo sapiens
  Payload ID: 6495
  Gene Symbol: FAH
  Gene Name: fumarylacetoacetate hydrolase (fumarylacetoacetase)
  Uniprot ID: P16930
  ENSP ID: ENSP00000454271
MGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSFGTTVSPWVVPMDALMPFAVPNPKQDPRPLPYLCHDEPYTFDINLSVNLKGEGMSQAATICKSNFKYMYWTMLQQLTHHSVNGCNLRPGDLLASGTISGPEPENFGSMLELSWKGTKPIDLGNGQTRKFLLDGDEVIITGYCQGDGYRIGFGQCAGKVLPALLPS

SEQ ID NO: 33064 - protein, 60 aa, Homo sapiens
  Payload ID: 6495
  Gene Symbol: FAH
  Gene Name: fumarylacetoacetate hydrolase (fumarylacetoacetase)
  ENSP ID: ENSP00000454952
  MOD_RES (1)..(1): Any amino acid
XNLKGEGMSQAATICKSNFKYMYWTMLQQLTHHSVNGCNLRPGDLLASGTISGPVSIWLH

SEQ ID NO: 33065 - protein, 248 aa, Homo sapiens
  Payload ID: 6496
  Gene Symbol: FAHD1
  Gene Name: fumarylacetoacetate hydrolase domain containing 1
  Uniprot ID: Q6P587
  ENSP ID: ENSP00000372112
MGIMAASRPLSRFWEWGKNIVCVGRNYADHVREMRSAVLSEPVLFLKPSTAYAPEGSPILMPAYTRNLHHELELGVVMGKRCRAVPEAAAMDYVGGYALCLDMTARDVQDECKKKGLPWTLAKSFTASCPVSAFVPKEKIPDPHKLKLWLKVNGELRQEGETSSMIFSIPYIISYVSKIITLEEGDIILTGTPKGVGPVKENDEIEAGIHGLRQGLTLSPKLECSSAITAHCSLELPGSSNPPSASRF

SEQ ID NO: 33066 - protein, 226 aa, Homo sapiens
  Payload ID: 6496
  Gene Symbol: FAHD1
  Gene Name: fumarylacetoacetate hydrolase domain containing 1
  Uniprot ID: Q6P587
  ENSP ID: ENSP00000372114
MGIMAASRPLSRFWEWGKNIVCVGRNYADHVREMRSAVLSEPVLFLKPSTAYAPEGSPILMPAYTRNLHHELELGVVMGKRCRAVPEAAAMDYVGGYALCLDMTARDVQDECKKKGLPWTLAKSFTASCPVSAFVPKEKIPDPHKLKLWLKVNGELRQEGETSSMIFSIPYIISYVSKIITLEEGDIILTGTPKGVGPVKENDEIEAGIHGLPKVSSATLPVRLQE

SEQ ID NO: 33067 - protein, 224 aa, Homo sapiens
  Payload ID: 6496
  Gene Symbol: FAHD1
  Gene Name: fumarylacetoacetate hydrolase domain containing 1
  Uniprot ID: Q6P587
  ENSP ID: ENSP00000398053
MGIMAASRPLSRFWEWGKNIVCVGRNYADHVREMRSAVLSEPVLFLKPSTAYAPEGSPILMPAYTRNLHHELELGVVMGKRCRAVPEAAAMDYVGGYALCLDMTARDVQDECKKKGLPWTLAKSFTASCPVSAFVPKEKIPDPHKLKLWLKVNGELRQEGETSSMIFSIPYIISYVSKIITLEEGDIILTGTPKGVGPVKENDEIEAGIHGLVSMTFKVEKPEY

SEQ ID NO: 33068 - protein, 248 aa, Homo sapiens; identical to SEQ ID NO: 33065
  Payload ID: 6496
  Gene Symbol: FAHD1
  Gene Name: fumarylacetoacetate hydrolase domain containing 1
  Uniprot ID: Q6P587
  ENSP ID: ENSP00000482534

SEQ ID NO: 33069 - protein, 314 aa, Homo sapiens
  Payload ID: 6497
  Gene Symbol: FAHD2A
  Gene Name: fumarylacetoacetate hydrolase domain containing 2A
  Uniprot ID: Q96GK7
  ENSP ID: ENSP00000233379
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKATDAMAHVAGFTVAHDVSARDWQMRRNGKQWLLGKTFDTFCPLGPALVTKDSVADPHNLKICCRVNGEVVQSGNTNQMVFKTEDLIAWVSQFVTFYPGDVILTGTPPGVGVFRKPPVFLKKGDEVQCEIEELGVIINKVV

SEQ ID NO: 33070 - protein, 127 aa, Homo sapiens
  Payload ID: 6497
  Gene Symbol: FAHD2A
  Gene Name: fumarylacetoacetate hydrolase domain containing 2A
  ENSP ID: ENSP00000390528
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVP

SEQ ID NO: 33071 - protein, 81 aa, Homo sapiens
  Payload ID: 6497
  Gene Symbol: FAHD2A
  Gene Name: fumarylacetoacetate hydrolase domain containing 2A
  ENSP ID: ENSP00000405148
MLVSGRRRLLTVLLQAQKWPFQPSRDMRLVQFRAPHLVGPHLGLETGNGGGVINLNAFDPTLPKTMTQFLEQGEATLSVAR

SEQ ID NO: 33072 - protein, 314 aa, Homo sapiens; identical to SEQ ID NO: 33069
  Payload ID: 6497
  Gene Symbol: FAHD2A
  Gene Name: fumarylacetoacetate hydrolase domain containing 2A
  Uniprot ID: Q96GK7
  ENSP ID: ENSP00000406424

SEQ ID NO: 33073 - protein, 314 aa, Homo sapiens
  Payload ID: 6498
  Gene Symbol: FAHD2B
  Gene Name: fumarylacetoacetate hydrolase domain containing 2B
  Uniprot ID: Q6P2I3
  ENSP ID: ENSP00000272610
MLVSGRRRLLTALLQAQKWPFQPSRDMRLVQFRAPHLVGPHLGLETGNGGGVINLNAFDPTLPKTMTQFLEQGEATLSVARRALAAQLPVLPWSEVTFLAPVTWPDKVVCVGMNYVDHCKEQNVPVPKEPIIFSKFASSIVGPYDEVVLPPQSQEVDWEVELAVVIGKKGKHIKATDAMAHVAGFTVAHDVSARDWLTRRNGKQWLLGKTFDTFCPLGPALVTKDSVADPHNLKICCRVNGEVVQSSNTNQMVFKTEDLIAWVSQFVTFYPGDVILTGTPPGVGVFRKPPVFLKKGDEVQCEIEELGVIINKVV

SEQ ID NO: 33074 - protein, 314 aa, Homo sapiens; identical to SEQ ID NO: 33073
  Payload ID: 6498
  Gene Symbol: FAHD2B
  Gene Name: fumarylacetoacetate hydrolase domain containing 2B
  Uniprot ID: Q6P2I3
  ENSP ID: ENSP00000410470

SEQ ID NO: 33075 - protein, 155 aa, Homo sapiens
  Payload ID: 6499
  Gene Symbol: FUNDC1
  Gene Name: FUN14 domain containing 1
  Uniprot ID: Q8IVP5
  ENSP ID: ENSP00000367284
MATRNPPPQDYESDDDSYEVLDLTEYARRHQWWNRVFGHSSGPMVEKYSVATQIVMGGVTGWCAGFLFQKVGKLAATAVGGGFLLLQIASHSGYVQIDWKRVEKDVNKAKRQIKKRANKAAPEINNLIEEATEFIKQNIVISSGFVGGFLLGLAS

SEQ ID NO: 33076 - protein, 189 aa, Homo sapiens
  Payload ID: 6500
  Gene Symbol: FUNDC2
  Gene Name: FUN14 domain containing 2
  Uniprot ID: Q9BWH2
  ENSP ID: ENSP00000358510
METSAPRAGSQVVATTARHSAAYRADPLRVSSRDKLTEMAASSQGNFEGNFESLDLAEFAKKQPWWRKLFGQESGPSAEKYSVATQLFIGGVTGWCTGFIFQKVGKLAATAVGGGFFLLQLANHTGYIKVDWQRVEKDMKKAKEQLKIRKSNQIPTEVRSKAEEVVSFVKKNVLVTGGFFGGFLLGMAS

SEQ ID NO: 33077 - protein, 94 aa, Homo sapiens
  Payload ID: 6500
  Gene Symbol: FUNDC2
  Gene Name: FUN14 domain containing 2
  ENSP ID: ENSP00000395488
SLDLAEFAKKQPWWRKLFGQESGPSAEKYSVATQLFIGGVTGWCTGFIFQKVGKLAATAVGGGFFLLQLATLTFASLQTILGTSKLTGNEWRRT

SEQ ID NO: 33078 - protein, 794 aa, Homo sapiens
  Payload ID: 6501
  Gene Symbol: FURIN
  Gene Name: furin (paired basic amino acid cleaving enzyme)
  Uniprot ID: P09958
  ENSP ID: ENSP00000268171
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 33079 - protein, 69 aa, Homo sapiens
  Payload ID: 6501
  Gene Symbol: FURIN
  Gene Name: furin (paired basic amino acid cleaving enzyme)
  ENSP ID: ENSP00000452730
MELRPWLLWVVAATGTLVLLAADAQGQKVFTNTWAVRIPGGPAVANSVARKHGFLNLGQIFGDYYHFWH

SEQ ID NO: 33080 - protein, 175 aa, Homo sapiens
  Payload ID: 6501
  Gene Symbol: FURIN
  Gene Name: furin (paired basic amino acid cleaving enzyme)
  ENSP ID: ENSP00000453212
MELRPWLLWVVAATGTLVLLAADAQGQKVFTNTWAVRIPGGPAVANSVARKHGFLNLGQIFGDYYHFWHRGVTKRSLSPHRPRHSRLQREPQWLEQQVAKRRTKRDVYQEPTDPKFPQQWYLSGVTQRDLNVKAAWAQGYTGHGIVVSILDDGIEKNHPDLAGNYDPGASFDVND

SEQ ID NO: 33081 - protein, 216 aa, Homo sapiens
  Payload ID: 6501
  Gene Symbol: FURIN
  Gene Name: furin (paired basic amino acid cleaving enzyme)
  ENSP ID: ENSP00000453942
PNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPK

SEQ ID NO: 33082 - protein, 794 aa, Homo sapiens; identical to SEQ ID NO: 33078
  Payload ID: 6501
  Gene Symbol: FURIN
  Gene Name: furin (paired basic amino acid cleaving enzyme)
  Uniprot ID: P09958
  ENSP ID: ENSP00000483552

SEQ ID NO: 33083 - protein, 794 aa, Homo sapiens; identical to SEQ ID NO: 33078
  Payload ID: 6501
  Gene Symbol: FURIN
  Gene Name: furin (paired basic amino acid cleaving enzyme)
  Uniprot ID: P09958
  ENSP ID: ENSP00000484952

SEQ ID NO: 33084 - protein, 195 aa, Homo sapiens
  Payload ID: 6502
  Gene Symbol: FRY
  Gene Name: furry homolog (Drosophila)
  ENSP ID: ENSP00000369565
MESLAQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 33085 - protein, 3012 aa, Homo sapiens
  Payload ID: 6502
  Gene Symbol: FRY
  Gene Name: furry homolog (Drosophila)
  ENSP ID: ENSP00000369600
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSGKPAIPHNTPQRAPDHAYLPAALAAQHRAGGQQAPPPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 33086 - protein, 150 aa, Homo sapiens
  Payload ID: 6502
  Gene Symbol: FRY
  Gene Name: furry homolog (Drosophila)
  ENSP ID: ENSP00000398010
MEITTACWRRSCVISFIKGLASPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKS

SEQ ID NO: 33087 - protein, 132 aa, Homo sapiens
  Payload ID: 6502
  Gene Symbol: FRY
  Gene Name: furry homolog (Drosophila)
  ENSP ID: ENSP00000434694
EPHSFNTRMSSFDASLPDMNNLQISEGSKAEAVREEEDTTVHEDDLSSSINELPAAFECSDSFSLDMTEGEEKGNRALDQFTLASPQPVTMPRRPGAATSTSLCVTQMAPVLCIHFMCSPPCLRIFRKGSAS

SEQ ID NO: 33088 - protein, 3013 aa, Homo sapiens
  Payload ID: 6502
  Gene Symbol: FRY
  Gene Name: furry homolog (Drosophila)
  Uniprot ID: Q5TBA9
  ENSP ID: ENSP00000445043
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 33089 - protein, 526 aa, Homo sapiens
  Payload ID: 6503
  Gene Symbol: FUS
  Gene Name: FUS RNA binding protein
  Uniprot ID: P35637
  ENSP ID: ENSP00000254108
MASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 33090 - protein, 525 aa, Homo sapiens
  Payload ID: 6503
  Gene Symbol: FUS
  Gene Name: FUS RNA binding protein
  Uniprot ID: P35637
  ENSP ID: ENSP00000369594
MASNDYTQQATQSYGAYPTQPGQGYSQQSSQPYGQQSYSGYSQSTDTSGYGQSSYSSYGQSQNSYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 33091 - protein, 263 aa, Homo sapiens
  Payload ID: 6503
  Gene Symbol: FUS
  Gene Name: FUS RNA binding protein
  ENSP ID: ENSP00000455073
MASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGPSGPRITS

SEQ ID NO: 33092 - protein, 527 aa, Homo sapiens
  Payload ID: 6503
  Gene Symbol: FUS
  Gene Name: FUS RNA binding protein
  ENSP ID: ENSP00000455282
MASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSAEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 33093 - protein, 418 aa, Homo sapiens
  Payload ID: 6504
  Gene Symbol: FUZ
  Gene Name: fuzzy planar cell polarity protein
  Uniprot ID: Q9BT04
  ENSP ID: ENSP00000313309
MGEEGTGGTVHLLCLAASSGVPLFCRSSRGGAPARQQLPFSVIGSLNGVHMFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 33094 - protein, 78 aa, Homo sapiens
  Payload ID: 6504
  Gene Symbol: FUZ
  Gene Name: fuzzy planar cell polarity protein
  ENSP ID: ENSP00000366296
MGEEGTGGTVHLLCLAASSGVPLFCRSSRGGAPARQQLPFSVIGSLNGVHMFGQNLEVQLSSARTENTTVHHPHCSVI

SEQ ID NO: 33095 - protein, 86 aa, Homo sapiens
  Payload ID: 6504
  Gene Symbol: FUZ
  Gene Name: fuzzy planar cell polarity protein
  ENSP ID: ENSP00000431388
MFGQNLEVQLSSARTENTTVVWKSFHDSITLIVLSSEVGISELRLERLLQMVFGAMVLLVGLEELTNIRNVERLKKDLRAGPFFLS

SEQ ID NO: 33096 - protein, 86 aa, Homo sapiens
  Payload ID: 6504
  Gene Symbol: FUZ
  Gene Name: fuzzy planar cell polarity protein
  ENSP ID: ENSP00000431420
MGEEGTGGTVHLLCLAASSGVPLFCRSSRGGAPARQQLPFSVIGSLNGVHMFGQNLEVQLSSARTENTTVVWKSFHDRSFLWDLKN

SEQ ID NO: 33097 - protein, 368 aa, Homo sapiens
  Payload ID: 6504
  Gene Symbol: FUZ
  Gene Name: fuzzy planar cell polarity protein
  ENSP ID: ENSP00000431731
MFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 33098 - protein, 56 aa, Homo sapiens
  Payload ID: 6504
  Gene Symbol: FUZ
  Gene Name: fuzzy planar cell polarity protein
  ENSP ID: ENSP00000432148
  MOD_RES (1)..(1): Any amino acid
XLLLLHLELKRCLFTVEPLGDKAEPSPEQRRRLLRNFYTLVTSTHFPPVPLHVMKE

SEQ ID NO: 33099 - protein, 86 aa, Homo sapiens; identical to SEQ ID NO: 33096
  Payload ID: 6504
  Gene Symbol: FUZ
  Gene Name: fuzzy planar cell polarity protein
  ENSP ID: ENSP00000433164

SEQ ID NO: 33100 - protein, 86 aa, Homo sapiens; identical to SEQ ID NO: 33096
  Payload ID: 6504
  Gene Symbol: FUZ
  Gene Name: fuzzy planar cell polarity protein
  ENSP ID: ENSP00000433492

SEQ ID NO: 33101 - protein, 382 aa, Homo sapiens
  Payload ID: 6504
  Gene Symbol: FUZ
  Gene Name: fuzzy planar cell polarity protein
  Uniprot ID: Q9BT04
  ENSP ID: ENSP00000435177
MGEEGTGGTVHLLCLAASSGVPLFCRSSRGGAPARQQLPFSVIGSLNGVHMFGQNLEVQLSSARTENTTVVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 33102 - protein, 95 aa, Homo sapiens
  Payload ID: 6504
  Gene Symbol: FUZ
  Gene Name: fuzzy planar cell polarity protein
  ENSP ID: ENSP00000469856
MGEEGTGGTVHLLCLAASSGVPLFCRSSRGGAPARQQLPFSVIGSLNGVHMFGQNLEVQLSSARTENTTVVWKSFHDRSPGGNVGQGQGLGDSPC

SEQ ID NO: 33103 - protein, 78 aa, Homo sapiens
  Payload ID: 6504
  Gene Symbol: FUZ
  Gene Name: fuzzy planar cell polarity protein
  ENSP ID: ENSP00000470155
MGEEGTGGTVHLLCLAASSGVPLFCRSSRGGAPARQQNLEVQLSSARTENTTVVWKSFHDRSPGGNVGQGQGLGDSPC

SEQ ID NO: 33104 - protein, 45 aa, Homo sapiens
  Payload ID: 6504
  Gene Symbol: FUZ
  Gene Name: fuzzy planar cell polarity protein
  ENSP ID: ENSP00000470863
MGEEGTGGTVHLLCLAASSGVPLFCRSSRGGAPARQQHHPHCSVI

SEQ ID NO: 33105 - protein, 45 aa, Homo sapiens
  Payload ID: 6504
  Gene Symbol: FUZ
  Gene Name: fuzzy planar cell polarity protein
  ENSP ID: ENSP00000471319
MFGQNLEVQLSSARTENTTVVWKSFHDRSPGGNVGQGQGLGDSPC

SEQ ID NO: 33106 - protein, 58 aa, Homo sapiens
  Payload ID: 6504
  Gene Symbol: FUZ
  Gene Name: fuzzy planar cell polarity protein
  ENSP ID: ENSP00000471793
MVFGAMVLLVGLEELTNIRNVERLKKDLRASYCLIDSFLGDSELIGDLTQCVDCVIPP

SEQ ID NO: 33107 - protein, 92 aa, Homo sapiens
  Payload ID: 6505
  Gene Symbol: FXYD1
  Gene Name: FXYD domain containing ion transport regulator 1
  Uniprot ID: O00168
  ENSP ID: ENSP00000343314
MASLGHILVFCVGLLTMAKAESPKEHDPFTYDYQSLQIGGLVIAGILFILGILIVLSRRCRCKFNQQQRTGEPDEEEGTFRSSIRRLSTRRR

SEQ ID NO: 33108 - protein, 92 aa, Homo sapiens; identical to SEQ ID NO: 33107
  Payload ID: 6505
  Gene Symbol: FXYD1
  Gene Name: FXYD domain containing ion transport regulator 1
  Uniprot ID: O00168
  ENSP ID: ENSP00000393611

SEQ ID NO: 33109 - protein, 92 aa, Homo sapiens; identical to SEQ ID NO: 33107
  Payload ID: 6505
  Gene Symbol: FXYD1
  Gene Name: FXYD domain containing ion transport regulator 1
  Uniprot ID: O00168
  ENSP ID: ENSP00000465289

SEQ ID NO: 33110 - protein, 92 aa, Homo sapiens; identical to SEQ ID NO: 33107
  Payload ID: 6505
  Gene Symbol: FXYD1
  Gene Name: FXYD domain containing ion transport regulator 1
  Uniprot ID: O00168
  ENSP ID: ENSP00000466398

SEQ ID NO: 33111 - protein, 92 aa, Homo sapiens; identical to SEQ ID NO: 33107
  Payload ID: 6505
  Gene Symbol: FXYD1
  Gene Name: FXYD domain containing ion transport regulator 1
  Uniprot ID: O00168
  ENSP ID: ENSP00000467727

SEQ ID NO: 33112 - protein, 115 aa, Homo sapiens
  Payload ID: 6505
  Gene Symbol: FXYD1
  Gene Name: FXYD domain containing ion transport regulator 1
  ENSP ID: ENSP00000467818
  MOD_RES (1)..(1): Any amino acid
XFCVGLLTMAKAESPKEHDPFTYDYQSLQIGGLVIAGILFILGILIVLTPPLARASWSYSAAWRPPGGSLSFSYLSTPTGRRCRCKFNQQQRTGEPDEEEGTFRSSIRRLSTRRR

SEQ ID NO: 33113 - protein, 92 aa, Homo sapiens; identical to SEQ ID NO: 33107
  Payload ID: 6505
  Gene Symbol: FXYD1
  Gene Name: FXYD domain containing ion transport regulator 1
  Uniprot ID: O00168
  ENSP ID: ENSP00000468535

SEQ ID NO: 33114 - protein, 92 aa, Homo sapiens; identical to SEQ ID NO: 33107
  Payload ID: 6505
  Gene Symbol: FXYD1
  Gene Name: FXYD domain containing ion transport regulator 1
  Uniprot ID: O00168
  ENSP ID: ENSP00000481244

SEQ ID NO: 33115 - protein, 64 aa, Homo sapiens
  Payload ID: 6506
  Gene Symbol: FXYD2
  Gene Name: FXYD domain containing ion transport regulator 2
  Uniprot ID: P54710
  ENSP ID: ENSP00000260287
MDRWYLGGSPKGDVDPFYYDYETVRNGGLIFAGLAFIVGLLILLSRRFRCGGNKKRRQINEDEP

SEQ ID NO: 33116 - protein, 66 aa, Homo sapiens
  Payload ID: 6506
  Gene Symbol: FXYD2
  Gene Name: FXYD domain containing ion transport regulator 2
  Uniprot ID: P54710
  ENSP ID: ENSP00000292079
MTGLSMDGGGSPKGDVDPFYYDYETVRNGGLIFAGLAFIVGLLILLSRRFRCGGNKKRRQINEDEP

SEQ ID NO: 33117 - protein, 64 aa, Homo sapiens; identical to SEQ ID NO: 33115
  Payload ID: 6506
  Gene Symbol: FXYD2
  Gene Name: FXYD domain containing ion transport regulator 2
  Uniprot ID: P54710
  ENSP ID: ENSP00000432430

SEQ ID NO: 33118 - protein, 64 aa, Homo sapiens; identical to SEQ ID NO: 33115
  Payload ID: 6506
  Gene Symbol: FXYD2
  Gene Name: FXYD domain containing ion transport regulator 2
  Uniprot ID: P54710
  ENSP ID: ENSP00000436414

SEQ ID NO: 33119 - protein, 113 aa, Homo sapiens
  Payload ID: 6507
  Gene Symbol: FXYD3
  Gene Name: FXYD domain containing ion transport regulator 3
  Uniprot ID: Q14802
  ENSP ID: ENSP00000328259
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSGHHPGETPPLITPGSAQS

SEQ ID NO: 33120 - protein, 113 aa, Homo sapiens; identical to SEQ ID NO: 33119
  Payload ID: 6507
  Gene Symbol: FXYD3
  Gene Name: FXYD domain containing ion transport regulator 3
  Uniprot ID: Q14802
  ENSP ID: ENSP00000339499

SEQ ID NO: 33121 - protein, 113 aa, Homo sapiens; identical to SEQ ID NO: 33119
  Payload ID: 6507
  Gene Symbol: FXYD3
  Gene Name: FXYD domain containing ion transport regulator 3
  Uniprot ID: Q14802
  ENSP ID: ENSP00000389770

SEQ ID NO: 33122 - protein, 144 aa, Homo sapiens
  Payload ID: 6507
  Gene Symbol: FXYD3
  Gene Name: FXYD domain containing ion transport regulator 3
  Uniprot ID: Q14802
  ENSP ID: ENSP00000473929
MGRGYSGALQARGGLEEPLERGLRGPSFTQSPLHGAAAAYLSAQRDASLPVPGQRSDMQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 33123 - protein, 61 aa, Homo sapiens
  Payload ID: 6507
  Gene Symbol: FXYD3
  Gene Name: FXYD domain containing ion transport regulator 3
  Uniprot ID: Q14802
  ENSP ID: ENSP00000474055
MQKVTLGLLVFLAGFPVLDANDLEDKNSPFYYGESPCPLSPPHNPTYCLVPRVPIQGWGLT

SEQ ID NO: 33124 - protein, 116 aa, Homo sapiens
  Payload ID: 6507
  Gene Symbol: FXYD3
  Gene Name: FXYD domain containing ion transport regulator 3
  ENSP ID: ENSP00000474223
MQKVTLGLLVFLAGFPVLDANDLEDKNSPFYYGAPYIFVKRMGGQMERTQAGTEVPSTFLLDWHSLQVGGLICAGVLCAMGIIIVMSAKCKCKFGQKSGHHPGETPPLITPGSAQS

SEQ ID NO: 33125 - protein, 87 aa, Homo sapiens
  Payload ID: 6507
  Gene Symbol: FXYD3
  Gene Name: FXYD domain containing ion transport regulator 3
  Uniprot ID: Q14802
  ENSP ID: ENSP00000474438
MQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 33126 - protein, 70 aa, Homo sapiens
  Payload ID: 6507
  Gene Symbol: FXYD3
  Gene Name: FXYD domain containing ion transport regulator 3
  ENSP ID: ENSP00000474514
MQKVTLGLLVFLAGFPVLDANDLEDKNSPFYYDWHSLQVGGLICAGVLCAMGIIIVMSAKCKCKFGQKSG

SEQ ID NO: 33127 - protein, 87 aa, Homo sapiens; identical to SEQ ID NO: 33125
  Payload ID: 6507
  Gene Symbol: FXYD3
  Gene Name: FXYD domain containing ion transport regulator 3
  Uniprot ID: Q14802
  ENSP ID: ENSP00000474526

SEQ ID NO: 33128 - protein, 96 aa, Homo sapiens
  Payload ID: 6507
  Gene Symbol: FXYD3
  Gene Name: FXYD domain containing ion transport regulator 3
  Uniprot ID: Q14802
  ENSP ID: ENSP00000474622
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSG

SEQ ID NO: 33129 - protein, 87 aa, Homo sapiens; identical to SEQ ID NO: 33125
  Payload ID: 6507
  Gene Symbol: FXYD3
  Gene Name: FXYD domain containing ion transport regulator 3
  Uniprot ID: Q14802
  ENSP ID: ENSP00000474851

SEQ ID NO: 33130 - protein, 61 aa, Homo sapiens; identical to SEQ ID NO: 33123
  Payload ID: 6507
  Gene Symbol: FXYD3
  Gene Name: FXYD domain containing ion transport regulator 3
  Uniprot ID: Q14802
  ENSP ID: ENSP00000474855

SEQ ID NO: 33131 - protein, 116 aa, Homo sapiens; identical to SEQ ID NO: 33124
  Payload ID: 6507
  Gene Symbol: FXYD3
  Gene Name: FXYD domain containing ion transport regulator 3
  ENSP ID: ENSP00000475056

SEQ ID NO: 33132 - protein, 89 aa, Homo sapiens
  Payload ID: 6508
  Gene Symbol: FXYD4
  Gene Name: FXYD domain containing ion transport regulator 4
  Uniprot ID: P59646
  ENSP ID: ENSP00000473361
MERVTLALLLLAGLTALEANDPFANKDDPFYYDWKNLQLSGLICGGLLAIAGIAAVLSGKCKCKSSQKQHSPVPEKAIPLITPGSATTC

SEQ ID NO: 33133 - protein, 89 aa, Homo sapiens; identical to SEQ ID NO: 33132
  Payload ID: 6508
  Gene Symbol: FXYD4
  Gene Name: FXYD domain containing ion transport regulator 4
  Uniprot ID: P59646
  ENSP ID: ENSP00000483791

SEQ ID NO: 33134 - protein, 178 aa, Homo sapiens
  Payload ID: 6509
  Gene Symbol: FXYD5
  Gene Name: FXYD domain containing ion transport regulator 5
  Uniprot ID: Q96DB9
  ENSP ID: ENSP00000344254
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNRCR

SEQ ID NO: 33135 - protein, 107 aa, Homo sapiens
  Payload ID: 6509
  Gene Symbol: FXYD5
  Gene Name: FXYD domain containing ion transport regulator 5
  Uniprot ID: Q96DB9
  ENSP ID: ENSP00000376051
MQTLSNIPCFCLHGSLLPSTDLATLSAHPTDDTTTLSERPSPSTDVQTDPQTLKPSGFHEDDPFFYDEHTLRKRGLLVAAVLFITGIIILTSGKCRQLSRLCRNRCR

SEQ ID NO: 33136 - protein, 96 aa, Homo sapiens
  Payload ID: 6509
  Gene Symbol: FXYD5
  Gene Name: FXYD domain containing ion transport regulator 5
  ENSP ID: ENSP00000376052
MSPSGRLCLLTIVGLILPTRGQTLKDTTSSSSADSTIMDIQVPTRAPDAVYTELQPTSPTPTWPADGAYITAYGVTHFLMNMLAVSSFFCLHTAPQ

SEQ ID NO: 33137 - protein, 178 aa, Homo sapiens; identical to SEQ ID NO: 33134
  Payload ID: 6509
  Gene Symbol: FXYD5
  Gene Name: FXYD domain containing ion transport regulator 5
  Uniprot ID: Q96DB9
  ENSP ID: ENSP00000376053

SEQ ID NO: 33138 - protein, 178 aa, Homo sapiens; identical to SEQ ID NO: 33134
  Payload ID: 6509
  Gene Symbol: FXYD5
  Gene Name: FXYD domain containing ion transport regulator 5
  Uniprot ID: Q96DB9
  ENSP ID: ENSP00000393848

SEQ ID NO: 33139 - protein, 178 aa, Homo sapiens; identical to SEQ ID NO: 33134
  Payload ID: 6509
  Gene Symbol: FXYD5
  Gene Name: FXYD domain containing ion transport regulator 5
  Uniprot ID: Q96DB9
  ENSP ID: ENSP00000443390

SEQ ID NO: 33140 - protein, 194 aa, Homo sapiens
  Payload ID: 6509
  Gene Symbol: FXYD5
  Gene Name: FXYD domain containing ion transport regulator 5
  ENSP ID: ENSP00000444839
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSENWGWVGRTPRPGGGLMTEGWVLKGPWAILF

SEQ ID NO: 33141 - protein, 123 aa, Homo sapiens
  Payload ID: 6509
  Gene Symbol: FXYD5
  Gene Name: FXYD domain containing ion transport regulator 5
  ENSP ID: ENSP00000465174
MSPSGRLCLLTIVGLILPTRGQTLKDTTSSSSADSTIMDIQVPTRAPGEERDTSIKILSLQITTATKIPNLDQTREFMDLCNEKVQMQSTQNSSPPLQPQPGLLMKHHNPRPRPSNWKERMGL

SEQ ID NO: 33142 - protein, 178 aa, Homo sapiens; identical to SEQ ID NO: 33134
  Payload ID: 6509
  Gene Symbol: FXYD5
  Gene Name: FXYD domain containing ion transport regulator 5
  Uniprot ID: Q96DB9
  ENSP ID: ENSP00000465667

SEQ ID NO: 33143 - protein, 194 aa, Homo sapiens; identical to SEQ ID NO: 33140
  Payload ID: 6509
  Gene Symbol: FXYD5
  Gene Name: FXYD domain containing ion transport regulator 5
  ENSP ID: ENSP00000467053

SEQ ID NO: 33144 - protein, 67 aa, Homo sapiens
  Payload ID: 6509
  Gene Symbol: FXYD5
  Gene Name: FXYD domain containing ion transport regulator 5
  ENSP ID: ENSP00000468168
MSPSGRLCLLTIVGLILPTRGWNRLWGRRQEQGAQEGGCWDVQAGGYRGRTRMGAVELSSTDHMDRR

SEQ ID NO: 33145 - protein, 95 aa, Homo sapiens
  Payload ID: 6510
  Gene Symbol: FXYD6
  Gene Name: FXYD domain containing ion transport regulator 6
  Uniprot ID: Q9H0Q3
  ENSP ID: ENSP00000260282
MELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 33146 - protein, 95 aa, Homo sapiens; identical to SEQ ID NO: 33145
  Payload ID: 6510
  Gene Symbol: FXYD6
  Gene Name: FXYD domain containing ion transport regulator 6
  Uniprot ID: Q9H0Q3
  ENSP ID: ENSP00000431427

SEQ ID NO: 33147 - protein, 95 aa, Homo sapiens; identical to SEQ ID NO: 33145
  Payload ID: 6510
  Gene Symbol: FXYD6
  Gene Name: FXYD domain containing ion transport regulator 6
  Uniprot ID: Q9H0Q3
  ENSP ID: ENSP00000431446

SEQ ID NO: 33148 - protein, 90 aa, Homo sapiens
  Payload ID: 6510
  Gene Symbol: FXYD6
  Gene Name: FXYD domain containing ion transport regulator 6
  ENSP ID: ENSP00000431913
MELVLVFLCSLLAPMVLASAAEKEKEMDPFHYDYQTLRIGGLVFAVVLFSVGILLILSRRCKCSFNQKPRAPGDEEAQVENLITANGNCP

SEQ ID NO: 33149 - protein, 95 aa, Homo sapiens; identical to SEQ ID NO: 33145
  Payload ID: 6510
  Gene Symbol: FXYD6
  Gene Name: FXYD domain containing ion transport regulator 6
  Uniprot ID: Q9H0Q3
  ENSP ID: ENSP00000433312

SEQ ID NO: 33150 - protein, 111 aa, Homo sapiens
  Payload ID: 6510
  Gene Symbol: FXYD6
  Gene Name: FXYD domain containing ion transport regulator 6
  ENSP ID: ENSP00000436629
MELVLVFLCSLLAPMVLASAEKEKEMDPFHYDYQTLRIGGLVFAVVLFSVGILLILSRRCKCSFNQKPRAPGDEEAQQQSPRKQRTEVQPSGGSLWNLRRLLEPLDANVDA

SEQ ID NO: 33151 - protein, 95 aa, Homo sapiens; identical to SEQ ID NO: 33145
  Payload ID: 6510
  Gene Symbol: FXYD6
  Gene Name: FXYD domain containing ion transport regulator 6
  Uniprot ID: Q9H0Q3
  ENSP ID: ENSP00000442756

SEQ ID NO: 33152 - protein, 95 aa, Homo sapiens; identical to SEQ ID NO: 33145
  Payload ID: 6510
  Gene Symbol: FXYD6
  Gene Name: FXYD domain containing ion transport regulator 6
  Uniprot ID: Q9H0Q3
  ENSP ID: ENSP00000463158

SEQ ID NO: 33153 - protein, 90 aa, Homo sapiens
  Payload ID: 6510
  Gene Symbol: FXYD6
  Gene Name: FXYD domain containing ion transport regulator 6
  ENSP ID: ENSP00000463160
MELVLVFLCSLLAPMVLASAAEKEKEMDPFHYDYQTLRIGGLVFAVVLFSVGILLILSRRCKCSFNQKPRNRAPESRELKCSHQVEASGT

SEQ ID NO: 33154 - protein, 90 aa, Homo sapiens; identical to SEQ ID NO: 33148
  Payload ID: 6510
  Gene Symbol: FXYD6
  Gene Name: FXYD domain containing ion transport regulator 6
  ENSP ID: ENSP00000464144

SEQ ID NO: 33155 - protein, 80 aa, Homo sapiens
  Payload ID: 6511
  Gene Symbol: FXYD7
  Gene Name: FXYD domain containing ion transport regulator 7
  Uniprot ID: P58549
  ENSP ID: ENSP00000270310
MATPTQTPTKAPEEPDPFYYDYNTVQTVGMTLATILFLLGILIVISKKVKCRKADSRSESPTCKSCKSELPSSAPGGGGV

SEQ ID NO: 33156 - protein, 117 aa, Homo sapiens
  Payload ID: 6511
  Gene Symbol: FXYD7
  Gene Name: FXYD domain containing ion transport regulator 7
  ENSP ID: ENSP00000465784
MATPTQTPTKAPEEPDPFYYDYNTVQTVGMTLATILFLLGILIVISKCDPFLGCLSLRFLCWLSSISYPLCPVFLFCLSLPTGKKVKCRKADSRSESPTCKSCKSELPSSAPGGGGV

SEQ ID NO: 33157 - protein, 77 aa, Homo sapiens
  Payload ID: 6511
  Gene Symbol: FXYD7
  Gene Name: FXYD domain containing ion transport regulator 7
  ENSP ID: ENSP00000466915
MATPTQTPTKAPEEPDPFYYDYNTVQTVGMTLATILFLLGILIVISKKVKCRKADSSPTCKSCKSELPSSAPGGGGV

SEQ ID NO: 33158 - protein, 112 aa, Homo sapiens
  Payload ID: 6512
  Gene Symbol: FXYD6-FXYD2
  Gene Name: FXYD6-FXYD2 readthrough
  ENSP ID: ENSP00000463024
MELVLVFLCSLLAPMVLASAAEKEKEMDPFHYDYQTLRIGGLVFAVVLFSVGILLILRPQEMRKPRWRTSSPPMQQSPRKQRTEVQPSGGRRQPQGGRGPVLLWQKIPLWGQ

SEQ ID NO: 33159 - protein, 144 aa, Homo sapiens
  Payload ID: 6512
  Gene Symbol: FXYD6-FXYD2
  Gene Name: FXYD6-FXYD2 readthrough
  ENSP ID: ENSP00000482442
MELVLVFLCSLLAPMVLASAAEKEKEMDPFHYDYQTLRIGGLVFAVVLFSVGILLILSRRCKCSFNQKPRNRAPESRELKCSHQVEGGSPKGDVDPFYYDYETVRNGGLIFAGLAFIVGLLILLSRRFRCGGNKKRRQINEDEP

SEQ ID NO: 33160 - protein, 783 aa, Homo sapiens
  Payload ID: 6513
  Gene Symbol: FYB
  Gene Name: FYN binding protein
  Uniprot ID: O15117
  ENSP ID: ENSP00000316460
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGFPAPPKQLDMGDEVYDDVDTSDFPVSSAEMSQGTNVGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 33161 - protein, 1 aa, Homo sapiens
  Payload ID: 6513
  Gene Symbol: FYB
  Gene Name: FYN binding protein
  ENSP ID: ENSP00000420989
M

SEQ ID NO: 33162 - protein, 62 aa, Homo sapiens
  Payload ID: 6513
  Gene Symbol: FYB
  Gene Name: FYN binding protein
  ENSP ID: ENSP00000421988
MAKYNTGGNPTEDVSVNSRPFRVTGPNSSSGIQARKNLFNNQGNASPPAGPSNVPKFGSPKP

SEQ ID NO: 33163 - protein, 22 aa, Homo sapiens
  Payload ID: 6513
  Gene Symbol: FYB
  Gene Name: FYN binding protein
  ENSP ID: ENSP00000423888
MAKYNTGGNPTEDVSVNSRPFR

SEQ ID NO: 33164 - protein, 114 aa, Homo sapiens
  Payload ID: 6513
  Gene Symbol: FYB
  Gene Name: FYN binding protein
  ENSP ID: ENSP00000424919
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVG

SEQ ID NO: 33165 - protein, 839 aa, Homo sapiens
  Payload ID: 6513
  Gene Symbol: FYB
  Gene Name: FYN binding protein
  Uniprot ID: O15117
  ENSP ID: ENSP00000425845
MDGKADVKSLMAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGSTLQVQEKSNTWSWGILKMLKGKDDRKKSIREKPKVSDSDNNEGSSFPAPPKQLDMGDEVYDDVDTSDFPVSSAEMSQGTNVGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 33166 - protein, 783 aa, Homo sapiens; identical to SEQ ID NO: 33160
  Payload ID: 6513
  Gene Symbol: FYB
  Gene Name: FYN binding protein
  Uniprot ID: O15117
  ENSP ID: ENSP00000426346

SEQ ID NO: 33167 - protein, 174 aa, Homo sapiens
  Payload ID: 6513
  Gene Symbol: FYB
  Gene Name: FYN binding protein
  ENSP ID: ENSP00000426597
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLT

SEQ ID NO: 33168 - protein, 829 aa, Homo sapiens
  Payload ID: 6513
  Gene Symbol: FYB
  Gene Name: FYN binding protein
  Uniprot ID: O15117
  ENSP ID: ENSP00000427114
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGSTLQVQEKSNTWSWGILKMLKGKDDRKKSIREKPKVSDSDNNEGSSFPAPPKQLDMGDEVYDDVDTSDFPVSSAEMSQGTNVGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 33169 - protein, 482 aa, Homo sapiens
  Payload ID: 6514
  Gene Symbol: FYN
  Gene Name: FYN proto-oncogene, Src family tyrosine kinase
  Uniprot ID: P06241
  ENSP ID: ENSP00000229471
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 33170 - protein, 537 aa, Homo sapiens
  Payload ID: 6514
  Gene Symbol: FYN
  Gene Name: FYN proto-oncogene, Src family tyrosine kinase
  Uniprot ID: P06241
  ENSP ID: ENSP00000346671
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 33171 - protein, 537 aa, Homo sapiens; identical to SEQ ID NO: 33170
  Payload ID: 6514
  Gene Symbol: FYN
  Gene Name: FYN proto-oncogene, Src family tyrosine kinase
  Uniprot ID: P06241
  ENSP ID: ENSP00000357656

SEQ ID NO: 33172 - protein, 534 aa, Homo sapiens
  Payload ID: 6514
  Gene Symbol: FYN
  Gene Name: FYN proto-oncogene, Src family tyrosine kinase
  Uniprot ID: P06241
  ENSP ID: ENSP00000357667
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSEKADGLCFNLTVIASSCTPQTSGLAKDAWEVARRSLCLEKKLGQGCFAEVWLGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 33173 - protein, 534 aa, Homo sapiens; identical to SEQ ID NO: 33172
  Payload ID: 6514
  Gene Symbol: FYN
  Gene Name: FYN proto-oncogene, Src family tyrosine kinase
  Uniprot ID: P06241
  ENSP ID: ENSP00000357671

SEQ ID NO: 33174 - protein, 232 aa, Homo sapiens
  Payload ID: 6514
  Gene Symbol: FYN
  Gene Name: FYN proto-oncogene, Src family tyrosine kinase
  ENSP ID: ENSP00000427993
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYS

SEQ ID NO: 33175 - protein, 103 aa, Homo sapiens
  Payload ID: 6514
  Gene Symbol: FYN
  Gene Name: FYN proto-oncogene, Src family tyrosine kinase
  ENSP ID: ENSP00000428042
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSF

SEQ ID NO: 33176 - protein, 116 aa, Homo sapiens
  Payload ID: 6514
  Gene Symbol: FYN
  Gene Name: FYN proto-oncogene, Src family tyrosine kinase
  ENSP ID: ENSP00000428045
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSE

SEQ ID NO: 33177 - protein, 145 aa, Homo sapiens
  Payload ID: 6514
  Gene Symbol: FYN
  Gene Name: FYN proto-oncogene, Src family tyrosine kinase
  ENSP ID: ENSP00000428493
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQ

SEQ ID NO: 33178 - protein, 153 aa, Homo sapiens
  Payload ID: 6514
  Gene Symbol: FYN
  Gene Name: FYN proto-oncogene, Src family tyrosine kinase
  ENSP ID: ENSP00000428695
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGK

SEQ ID NO: 33179 - protein, 106 aa, Homo sapiens
  Payload ID: 6514
  Gene Symbol: FYN
  Gene Name: FYN proto-oncogene, Src family tyrosine kinase
  ENSP ID: ENSP00000428983
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKG

SEQ ID NO: 33180 - protein, 186 aa, Homo sapiens
  Payload ID: 6514
  Gene Symbol: FYN
  Gene Name: FYN proto-oncogene, Src family tyrosine kinase
  ENSP ID: ENSP00000429294
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYS

SEQ ID NO: 33181 - protein, 70 aa, Homo sapiens
  Payload ID: 6514
  Gene Symbol: FYN
  Gene Name: FYN proto-oncogene, Src family tyrosine kinase
  ENSP ID: ENSP00000429590
MGCVQCKDKEATKLTEERDGSLNQSSGYRYGTDPTPQHYPSFGVTSIPNYNNFHAAGGQGLTVFGGVTLF

SEQ ID NO: 33182 - protein, 118 aa, Homo sapiens
  Payload ID: 6514
  Gene Symbol: FYN
  Gene Name: FYN proto-oncogene, Src family tyrosine kinase
  ENSP ID: ENSP00000429813
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGD

SEQ ID NO: 33183 - protein, 175 aa, Homo sapiens
  Payload ID: 6514
  Gene Symbol: FYN
  Gene Name: FYN proto-oncogene, Src family tyrosine kinase
  ENSP ID: ENSP00000429866
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLI

SEQ ID NO: 33184 - protein, 139 aa, Homo sapiens
  Payload ID: 6514
  Gene Symbol: FYN
  Gene Name: FYN proto-oncogene, Src family tyrosine kinase
  ENSP ID: ENSP00000429992
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVA

SEQ ID NO: 33185 - protein, 152 aa, Homo sapiens
  Payload ID: 6514
  Gene Symbol: FYN
  Gene Name: FYN proto-oncogene, Src family tyrosine kinase
  ENSP ID: ENSP00000430364
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFG

SEQ ID NO: 33186 - protein, 64 aa, Homo sapiens
  Payload ID: 6514
  Gene Symbol: FYN
  Gene Name: FYN proto-oncogene, Src family tyrosine kinase
  ENSP ID: ENSP00000430455
MGCVQCKDKEATKLTEERDGSLNQSSGYRYGTDPTPQHYPSFGVTSIPNYNNFHAAGGQGLTVF

SEQ ID NO: 33187 - protein, 534 aa, Homo sapiens; identical to SEQ ID NO: 33172
  Payload ID: 6514
  Gene Symbol: FYN
  Gene Name: FYN proto-oncogene, Src family tyrosine kinase
  Uniprot ID: P06241
  ENSP ID: ENSP00000440646

SEQ ID NO: 33188 - protein, 505 aa, Homo sapiens
  Payload ID: 6515
  Gene Symbol: FRK
  Gene Name: fyn-related Src family tyrosine kinase
  Uniprot ID: P42685
  ENSP ID: ENSP00000476145
MSNICQRLWEYLEPYLPCLSTEADKSTVIENPGALCSPQSQRHGHYFVALFDYQARTAEDLSFRAGDKLQVLDTLHEGWWFARHLEKRRDGSSQQLQGYIPSNYVAEDRSLQAEPWFFGAIGRSDAEKQLLYSENKTGSFLIRESESQKGEFSLSVLDGAVVKHYRIKRLDEGGFFLTRRRIFSTLNEFVSHYTKTSDGLCVKLGKPCLKIQVPAPFDLSYKTVDQWEIDRNSIQLLKRLGSGQFGEVWEGLWNNTTPVAVKTLKPGSMDPNDFLREAQIMKNLRHPKLIQLYAVCTLEDPIYIITELMRHGSLQEYLQNDTGSKIHLTQQVDMAAQVASGMAYLESRNYIHRDLAARNVLVGEHNIYKVADFGLARVFKVDNEDIYESRHEIKLPVKWTAPEAIRSNKFSIKSDVWSFGILLYEIITYGKMPYSGMTGAQVIQMLAQNYRLPQPSNCPQQFYNIMLECWNAEPKERPTFETLRWKLEDYFETDSSYSDANNFIR

SEQ ID NO: 33189 - protein, 1478 aa, Homo sapiens
  Payload ID: 6516
  Gene Symbol: FYCO1
  Gene Name: FYVE and coiled-coil domain containing 1
  Uniprot ID: Q9BQS8
  ENSP ID: ENSP00000296137
MASTNAESQLQRIIRDLQDAVTELSKEFQEAGEPITDDSTSLHKFSYKLEYLLQFDQKEKATLLGNKKDYWDYFCACLAKVKGANDGIRFVKSISELRTSLGKGRAFIRYSLVHQRLADTLQQCFMNTKVTSDWYYARSPFLQPKLSSDIVGQLYELTEVQFDLASRGFDLDAAWPTFARRTLTTGSSAYLWKPPSRSSSMSSLVSSYLQTQEMVSNFDLNSPLNNEALEGFDEMRLELDQLEVREKQLRERMQQLDRENQELRAAVSQQGEQLQTERERGRTAAEDNVRLTCLVAELQKQWEVTQATQNTVKELQTCLQGLELGAAEKEEDYHTALRRLESMLQPLAQELEATRDSLDKKNQHLASFPGWLAMAQQKADTASDTKGRQEPIPSDAAQEMQELGEKLQALERERTKVEEVNRQQSAQLEQLVKELQLKEDARASLERLVKEMAPLQEELSGKGQEADQLWRRLQELLAHTSSWEEELAELRREKKQQQEEKELLEQEVRSLTRQLQFLETQLAQVSQHVSDLEEQKKQLIQDKDHLSQQVGMLERLAGPPGPELPVAGEKNEALVPVNSSLQEAWGKPEEEQRGLQEAQLDDTKVQEGSQEEELRQANRELEKELQNVVGRNQLLEGKLQALQADYQALQQRESAIQGSLASLEAEQASIRHLGDQMEASLLAVRKAKEAMKAQMAEKEAILQSKEGECQQLREEVEQCQQLAEARHRELRALESQCQQQTQLIEVLTAEKGQQGVGPPTDNEARELAAQLALSQAQLEVHQGEVQRLQAQVVDLQAKMRAALDDQDKVQSQLSMAEAVLREHKTLVQQLKEQNEALNRAHVQELLQCSEREGALQEERADEAQQREEELRALQEELSQAKCSSEEAQLEHAELQEQLHRANTDTAELGIQVCALTVEKERVEEALACAVQELQDAKEAASREREGLERQVAGLQQEKESLQEKLKAAKAAAGSLPGLQAQLAQAEQRAQSLQEAAHQELNTLKFQLSAEIMDYQSRLKNAGEECKSLRGQLEEQGRQLQAAEEAVEKLKATQADMGEKLSCTSNHLAECQAAMLRKDKEGAALREDLERTQKELEKATTKIQEYYNKLCQEVTNRERNDQKMLADLDDLNRTKKYLEERLIELLRDKDALWQKSDALEFQQKLSAEERWLGDTEANHCLDCKREFSWMVRRHHCRICGRIFCYYCCNNYVLSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 33190 - protein, 267 aa, Homo sapiens
  Payload ID: 6516
  Gene Symbol: FYCO1
  Gene Name: FYVE and coiled-coil domain containing 1
  ENSP ID: ENSP00000388136
  MOD_RES (1)..(1): Any amino acid
XSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 33191 - protein, 149 aa, Homo sapiens
  Payload ID: 6516
  Gene Symbol: FYCO1
  Gene Name: FYVE and coiled-coil domain containing 1
  ENSP ID: ENSP00000398517
MPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 33192 - protein, 1498 aa, Homo sapiens
  Payload ID: 6516
  Gene Symbol: FYCO1
  Gene Name: FYVE and coiled-coil domain containing 1
  Uniprot ID: Q9BQS8
  ENSP ID: ENSP00000441178
MASTNAESQLQRIIRDLQDAVTELSKEFQEAGEPITDDSTSLHKFSYKLEYLLQFDQKEKATLLGNKKDYWDYFCACLAKVKGANDGIRFVKSISELRTSLGKGRAFIRYSLVHQRLADTLQQCFMNTKVTSDWYYARSPFLQPKLSSDIVGQLYELTEVQFDLASRGFDLDAAWPTFARRTLTTGSSAYLWKPPSRSSSMSSLVSSYLQTQEMVSNFDLNSPLNNEALEGFDEMRLELDQLEVREKQLRERMQQLDRENQELRAAVSQQGEQLQTERERGRTAAEDNVRLTCLVAELQKQWEVTQATQNTVKELQTCLQGLELGAAEKEEDYHTALRRLESMLQPLAQELEATRDSLDKKNQHLASFPGWLAMAQQKADTASDTKGRQEPIPSDAAQEMQELGEKLQALERERTKVEEVNRQQSAQLEQLVKELQLKEDARASLERLVKEMAPLQEELSGKGQEADQLWRRLQELLAHTSSWEEELAELRREKKQQQEEKELLEQEVRSLTRQLQFLETQLAQVSQHVSDLEEQKKQLIQDKDHLSQQVGMLERLAGPPGPELPVAGEKNEALVPVNSSLQEAWGKPEEEQRGLQEAQLDDTKVQEGSQEEELRQANRELEKELQNVVGRNQLLEGKLQALQADYQALQQRESAIQGSLASLEAEQASIRHLGDQMEASLLAVRKAKEAMKAQMAEKEAILQSKEGECQQLREEVEQCQQLAEARHRELRALESQCQQQTQLIEVLTAEKGQQGVGPPTDNEARELAAQLALSQAQLEVHQGEVQRLQAQVVDLQAKMRAALDDQDKVQSQLSMAEAVLREHKTLVQQLKEQNEALNRAHVQELLQCSEREGALQEERADEAQQREEELRALQEELSQAKCSSEEAQLEHAELQEQLHRANTDTAELGIQVCALTVEKERVEEALACAVQELQDAKEAASREREGLERQVAGLQQEKESLQEKLKAAKAAAGSLPGLQAQLAQAEQRAQSLQEAAHQELNTLKFQLSAEIMDYQSRLKNAGEECKSLRGQLEEQGRQLQAAEEAVEKLKATQADMGEKLSCTSNHLAECQAAMLRKDKEGAALREDLERTQKELEKATTKIQEYYNKLCQEVTNRERNDQKMLADLDDLNRTKKYLEERLIELLRDKDALWQKSDALEFQQKLSAEERWLGDTEANHCLDCKREFSWMVRRHHCRICGRIFCYYCCNNYVLSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQASVGASKGLGNLLCESSACRDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 33193 - protein, 961 aa, Homo sapiens
  Payload ID: 6517
  Gene Symbol: FGD1
  Gene Name: FYVE, RhoGEF and PH domain containing 1
  Uniprot ID: P98174
  ENSP ID: ENSP00000364277
MHGHRAPGGAGPSEPEHPATNPPGAAPPACADSDPGASEPGLLARRGSGSALGGPLDPQFVGPSDTSLGAAPGHRVLPCGPSPQHHRALRFSYHLEGSQPRPGLHQGNRILVKSLSLDPGQSLEPHPEGPQRLRSDPGPPTETPSQRPSPLKRAPGPKPQVPPKPSYLQMPRMPPPLEPIPPPPSRPLPADPRVAKGLAPRAEASPSSAAVSSLIEKFEREPVIVASDRPVPGPSPGPPEPVMLPQPTSQPPVPQLPEGEASRCLFLLAPGPRDGEKVPNRDSGIDSISSPSNSEETCFVSDDGPPSHSLCPGPPALASVPVALADPHRPGSQEVDSDLEEEDDEEEEEEKDREIPVPLMERQESVELTVQQKVFHIANELLQTEKAYVSRLHLLDQVFCARLLEEARNRSSFPADVVHGIFSNICSIYCFHQQFLLPELEKRMEEWDRYPRIGDILQKLAPFLKMYGEYVKNFDRAVELVNTWTERSTQFKVIIHEVQKEEACGNLTLQHHMLEPVQRIPRYELLLKDYLLKLPHGSPDSKDAQKSLELIATAAEHSNAAIRKMERMHKLLKVYELLGGEEDIVSPTKELIKEGHILKLSAKNGTTQDRYLILFNDRLLYCVPRLRLLGQKFSVRARIDVDGMELKESSNLNLPRTFLVSGKQRSLELQARTEEEKKDWVQAINSTLLKHEQTLETFKLLNSTNREDEDTPPNSPNVDLGKRAPTPIREKEVTMCMRCQEPFNSITKRRHHCKACGHVVCGKCSEFRARLVYDNNRSNRVCTDCYVALHGVPGSSPACSQHTPQRRRSILEKQASVAAENSVICSFLHYMEKGGKGWHKAWFVVPENEPLVLYIYGAPQDVKAQRSLPLIGFEVGPPEAGERPDRRHVFKITQSHLSWYFSPETEELQRRWMAVLGRAGRGDTFCPGPTLSEDREMEEAPVAALGATAEPPESPQTRDKT

SEQ ID NO: 33194 - protein, 655 aa, Homo sapiens
  Payload ID: 6518
  Gene Symbol: FGD2
  Gene Name: FYVE, RhoGEF and PH domain containing 2
  Uniprot ID: Q7Z6J4
  ENSP ID: ENSP00000274963
MKGASEEKLASVSNLVTVFENSRTPEAAPRGQRLEDVHHRPECRPPESPGPREKTNVGEAVGSEPRTVSRRYLNSLKNKLSSEAWRKSCQPVTLSGSGTQEPEKKIVQELLETEQAYVARLHLLDQVFFQELLKTARSSKAFPEDVVRVIFSNISSIYQFHSQFFLPELQRRLDDWTANPRIGDVIQKLAPFLKMYSEYVKNFERAAELLATWTDKSPLFQEVLTRIQSSEASGSLTLQHHMLEPVQRIPRYELLLKEYIQKLPAQAPDQADAQKALDMIFSAAQHSNAAITEMERLQDLWEVYQRLGLEDDIVDPSNTLLREGPVLKISFRRNDPMERYLFLFNNMLLYCVPRVIQVGAQFQVRTRIDVAGMKVRELMDAEFPHSFLVSGKQRTLELQARSQEEMISWMQAFQAAIDQIEKRNETFKAAAQGPEGDIQEQELQSEELGLRAPQWVRDKMVTMCMRCQEPFNALTRRRHHCRACGYVVCARCSDYRAELKYDDNRPNRVCLHCYAFLTGNVLPEAKEDKRRGILEKGSSATPDQSLMCSFLQLIGDKWGKSGPRGWCVIPRDDPLVLYVYAAPQDMRAHTSIPLLGYQVTVGPQGDPRVFQLQQSGQLYTFKAETEELKGRWVKAMERAASGWSPSWPNDGDLSD

SEQ ID NO: 33195 - protein, 102 aa, Homo sapiens
  Payload ID: 6518
  Gene Symbol: FGD2
  Gene Name: FYVE, RhoGEF and PH domain containing 2
  ENSP ID: ENSP00000362635
MKGASEEKLASVSNLVTVFENSRTPEAAPRGQRLEDVHHRPECRPPESPGPREKTNVGEAVGSEPRTVSRRYLNSLKNKLSSEAWRKSCQPVTLSGSGTQDS

SEQ ID NO: 33196 - protein, 104 aa, Homo sapiens
  Payload ID: 6518
  Gene Symbol: FGD2
  Gene Name: FYVE, RhoGEF and PH domain containing 2
  ENSP ID: ENSP00000419657
MKGASEEKLASVSNLVTVFENSRTPEAAPRGQRLEDVHHRPECRPPESPGPREKTNVGEAVGSEPRTVSRRYLNSLKNKLSSEAWRKSCQPVTLSGSGTQVPEG

SEQ ID NO: 33197 - protein, 725 aa, Homo sapiens
  Payload ID: 6519
  Gene Symbol: FGD3
  Gene Name: FYVE, RhoGEF and PH domain containing 3
  Uniprot ID: Q5JSP0
  ENSP ID: ENSP00000336914
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 33198 - protein, 725 aa, Homo sapiens; identical to SEQ ID NO: 33197
  Payload ID: 6519
  Gene Symbol: FGD3
  Gene Name: FYVE, RhoGEF and PH domain containing 3
  Uniprot ID: Q5JSP0
  ENSP ID: ENSP00000364631

SEQ ID NO: 33199 - protein, 724 aa, Homo sapiens
  Payload ID: 6519
  Gene Symbol: FGD3
  Gene Name: FYVE, RhoGEF and PH domain containing 3
  Uniprot ID: Q5JSP0
  ENSP ID: ENSP00000413833
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTETPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 33200 - protein, 634 aa, Homo sapiens
  Payload ID: 6519
  Gene Symbol: FGD3
  Gene Name: FYVE, RhoGEF and PH domain containing 3
  Uniprot ID: Q5JSP0
  ENSP ID: ENSP00000432310
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEVGAPSSCSPPGGAAEPPDTCSCAPAAPAASAFGVSLGPG

SEQ ID NO: 33201 - protein, 235 aa, Homo sapiens
  Payload ID: 6520
  Gene Symbol: FGD4
  Gene Name: FYVE, RhoGEF and PH domain containing 4
  ENSP ID: ENSP00000379089
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQKIEWR

SEQ ID NO: 33202 - protein, 766 aa, Homo sapiens
  Payload ID: 6520
  Gene Symbol: FGD4
  Gene Name: FYVE, RhoGEF and PH domain containing 4
  Uniprot ID: Q96M96
  ENSP ID: ENSP00000394487
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 33203 - protein, 851 aa, Homo sapiens
  Payload ID: 6520
  Gene Symbol: FGD4
  Gene Name: FYVE, RhoGEF and PH domain containing 4
  ENSP ID: ENSP00000431323
MGGCSSTCPKIALVPPCSTSSTTTLVGENVSEEEAQGINGNRPAKHSAASPKPQVPPKPLHLQNSPSSNIHQTPRHKALPSAKPRMEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 33204 - protein, 878 aa, Homo sapiens
  Payload ID: 6520
  Gene Symbol: FGD4
  Gene Name: FYVE, RhoGEF and PH domain containing 4
  ENSP ID: ENSP00000433666
MNFKRVKPNIFLLNQSRLIISICEIMSTDQGSSTCPKIALVPPCSTSSTTTLVGENVSEEEAQGINGNRPAKHSAASPKPQVPPKPLHLQNSPSSNIHQTPRHKALPSAKPRMEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 33205 - protein, 65 aa, Homo sapiens
  Payload ID: 6520
  Gene Symbol: FGD4
  Gene Name: FYVE, RhoGEF and PH domain containing 4
  ENSP ID: ENSP00000434062
  MOD_RES (1)..(1): Any amino acid
XAETETKVQERENGESPLELEQLDQHHEMKETNEQKLHKIANELLLTERAYVNRLDLLDQKIEWR

SEQ ID NO: 33206 - protein, 207 aa, Homo sapiens
  Payload ID: 6520
  Gene Symbol: FGD4
  Gene Name: FYVE, RhoGEF and PH domain containing 4
  ENSP ID: ENSP00000434356
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKVEHETSS

SEQ ID NO: 33207 - protein, 235 aa, Homo sapiens; identical to SEQ ID NO: 33201
  Payload ID: 6520
  Gene Symbol: FGD4
  Gene Name: FYVE, RhoGEF and PH domain containing 4
  ENSP ID: ENSP00000437109

SEQ ID NO: 33208 - protein, 673 aa, Homo sapiens
  Payload ID: 6520
  Gene Symbol: FGD4
  Gene Name: FYVE, RhoGEF and PH domain containing 4
  ENSP ID: ENSP00000446695
MAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 33209 - protein, 903 aa, Homo sapiens
  Payload ID: 6520
  Gene Symbol: FGD4
  Gene Name: FYVE, RhoGEF and PH domain containing 4
  ENSP ID: ENSP00000449273
MSDEGGSNFRRVAIRRKSNPSYLPPGVPRPWSRPASHLGRVGTAAFKGQVPSGATGSSTCPKIALVPPCSTSSTTTLVGENVSEEEAQGINGNRPAKHSAASPKPQVPPKPLHLQNSPSSNIHQTPRHKALPSAKPRMEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 33210 - protein, 40 aa, Homo sapiens
  Payload ID: 6520
  Gene Symbol: FGD4
  Gene Name: FYVE, RhoGEF and PH domain containing 4
  ENSP ID: ENSP00000449614
MEEIKPASASCVSKEKPSKVSDLISRFEGGRRLMSKNFTK

SEQ ID NO: 33211 - protein, 30 aa, Homo sapiens
  Payload ID: 6520
  Gene Symbol: FGD4
  Gene Name: FYVE, RhoGEF and PH domain containing 4
  ENSP ID: ENSP00000462623
MEEIKPASASCVSKEKPSKVSDLISRFEGG

SEQ ID NO: 33212 - protein, 1462 aa, Homo sapiens
  Payload ID: 6521
  Gene Symbol: FGD5
  Gene Name: FYVE, RhoGEF and PH domain containing 5
  Uniprot ID: Q6ZNL6
  ENSP ID: ENSP00000285046
MFRGPKPPIAPKPRLTAPNEWRASVYLNDSLNKCSNGRLPCVDRGLDEGPRSIPKCSESETDEDYIVVPRVPLREDEPKDEGSVGNKALVSPESSAEEEEEREEGGEACGLEGTGAGEDSVAPAAPGAGALSREGEEGTDLALEDEGEGCADEPGTLEQVSRSEEEEKLVQPHRECSLEDSGPWAGEGVFQSDLLLPHIHGEDQEPPDTPGEAEEDDEEGCASTDPAGADEGSGPDRPTEDMGQDAEDTSEEPPEKEELAGVQEAETATDCPEVLEEGCEEATGVTGGEQVDLSEPPDHEKKTNQEVAAATLEDHAQDESAEESCQIVPFENDCMEDFVTSLTGSPYEFFPTESTSFCSESCSPLSESAKGLESEQAPKLGLRAEENPMVGALCGQCGSLQGGAAEGPAAPDVVVVLEEEALDDALANPYVMGVGLPGQAAPGEGGQAASDALGGYGSKEELNCEAEGGLVPADRKNTSTRVRPHSGKVAGYVPETVPEETGPEAGSSAPGIGGAAEEVGKTLLSLEGKPLEASRALPAKPRAFTLYPRSFSVEGREIPVSVYQEPEGSGLDDHRIKRKEDNLSLSCVIGSSGSFSQRNHLPSSGTSTPSSMVDIPPPFDLACITKKPITKSSPSLLIESDSPDKYKKKKSSFKRFLALTFKKKTENKLHVDVNVSSSRSSSESSYHGPSRILEVDRRSLSNSPQLKSRTGKLRASESPSSLIFYRDGKRKGVPFSRTVSRVESFEDRSRPPFLPLPLTKPRSISFPSADTSDYENIPAMNSDYENIQIPPRRPARAGAFTKLFEDQSRALSTANENDGYVDMSSFNAFESKQQSADQDAESAYTEPYKVCPISSAAPKEDLTSDEEQRSSEEEDSASRDPSVTHKVEGQSRALVIAQELLSSEKAYVEMLQHLNLDFHGAVMRALDDMDHEGRDTLAREELRQGLSELPAIHDLHQGILEELEERLSNWESQQKVADVFLAREQGFDHHATHILQFDRYLGLLSENCLHSPRLAAAVREFEQSVQGGSQTAKHRLLRVVQRLFQYQVLLTDYLNNLCPDSAEYDNTQGALSLISKVTDRANDSMEQGENLQKLVHIEHSVRGQGDLLQPGREFLKEGTLMKVTGKNRRPRHLFLMNDVLLYTYPQKDGKYRLKNTLAVANMKVSRPVMEKVPYALKIETSESCLMLSASSCAERDEWYGCLSRALPEDYKAQALAAFHHSVEIRERLGVSLGERPPTLVPVTHVMMCMNCGCDFSLTLRRHHCHACGKIVCRNCSRNKYPLKYLKDRMAKVCDGCFGELKKRGRAVPGLMRERPVSMSFPLSSPRFSGSAFSSVFQSINPSTFKKQKKVPSALTEVAASGEGSAISGYLSRCKRGKRHWKKLWFVIKGKVLYTYMASEDKVALESMPLLGFTIAPEKEEGSSEVGPIFHLYHKKTLFYSFKAEDTNSAQRWIEAMEDASVL

SEQ ID NO: 33213 - protein, 252 aa, Homo sapiens
  Payload ID: 6521
  Gene Symbol: FGD5
  Gene Name: FYVE, RhoGEF and PH domain containing 5
  ENSP ID: ENSP00000394827
  MOD_RES (1)..(1): Any amino acid
XQIPPRRPARAGAFTKLFEDQSRALSTANENDGYVDMSSFNAFESKQQSADQDAESAYTEPYKVCPISSAAPKEDLTSDEEQRSSEEEDSASRDPSVTHKDFHGAVMRALDDMDHEGRDTLAREELRQGLSELPAIHDLHQGILEELEERLSNWESQQKVADVFLAREQGFDHHATHILQFDRYLGLLSENCLHSPRLAAAVREFEQSVQGGSQTAKHRLLRVVQRLFQYQVLLTDYLNNLCPDSAEYDNTQ

SEQ ID NO: 33214 - protein, 1178 aa, Homo sapiens
  Payload ID: 6521
  Gene Symbol: FGD5
  Gene Name: FYVE, RhoGEF and PH domain containing 5
  ENSP ID: ENSP00000445949
MGQDAEDTSEEPPEKEELAGVQEAETATDCPEVLEEGCEEATGVTGGEQVDLSEPPDHEKKTNQEVAAATLEDHAQDESAEESCQIVPFENDCMEDFVTSLTGSPYEFFPTESTSFCSESCSPLSESAKGLESEQAPKLGLRAEENPMVGALCGQCGSLQGGAAEGPAAPDVVVVLEEEALDDALANPYVMGVGLPGQAAPGEGGQAASDALGGYGSKEELNCEAEGGLVPADRKNTSTRVRPHSGKVAGYVPETVPEETGPEAGSSAPGIGGAAEEVGKTLLSLEGKPLEASRALPAKPRAFTLYPRSFSVEGREIPVSVYQEPEGSGLDDHRIKRKEDNLSLSCVIGSSGSFSQRNHLPSSGTSTPSSMVDIPPPFDLACITKKPITKSSPSLLIESDSPDKYKKKKSSFKRFLALTFKKKTENKLHVDVNVSSSRSSSESSYHGPSRILEVDRRSLSNSPQLKSRTGKLRASESPSSLIFYRDGKRKGVPFSRTVSRVESFEDRSRPPFLPLPLTKPRSISFPSADTSDYENIPAMNSDYENIQIPPRRPARAGAFTKLFEDQSRALSTANENDGYVDMSSFNAFESKQQSADQDAESAYTEPYKVCPISSAAPKEDLTSDEEQRSSEEEDSASRDPSVTHKVEGQSRALVIAQELLSSEKAYVEMLQHLNLDFHGAVMRALDDMDHEGRDTLAREELRQGLSELPAIHDLHQGILEELEERLSNWESQQKVADVFLAREQGFDHHATHILQFDRYLGLLSENCLHSPRLAAAVREFEQSVQGGSQTAKHRLLRVVQRLFQYQVLLTDYLNNLCPDSAEYDNTQGALSLISKVTDRANDSMEQGENLQKLVHIEHSVRGQGDLLQPGREFLKEGTLMKVTGKNRRPRHLFLMNDVLLYTYPQKDGKYRLKNTLAVANMKVSRPVMEKVPYALKIETSESCLMLSASSCAERDEWYGCLSRALPEDYKAQALAAFHHSVEIRERLGVSLGERPPTLVPVTHVMMCMNCGCDFSLTLRRHHCHACGKIVCRNCSRNKYPLKYLKDRMAKVCDGCFGELKKRGRAVPGLMRERPVSMSFPLSSPRFSGSAFSSVFQSINPSTFKKQKKVPSALTEDKVALESMPLLGFTIAPEKEEGSSEVGPIFHLYHKKTLFYSFKAEDTNSAQRWIEAMEDASVL

SEQ ID NO: 33215 - protein, 1430 aa, Homo sapiens
  Payload ID: 6522
  Gene Symbol: FGD6
  Gene Name: FYVE, RhoGEF and PH domain containing 6
  Uniprot ID: Q6ZV73
  ENSP ID: ENSP00000344446
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEDVAALESQPLLGFTVIQVKDENSESKVFQLLHKNMLFYVFKAEDAHSAQKWIEAFQEGTIL

SEQ ID NO: 33216 - protein, 59 aa, Homo sapiens
  Payload ID: 6522
  Gene Symbol: FGD6
  Gene Name: FYVE, RhoGEF and PH domain containing 6
  ENSP ID: ENSP00000408291
MTSAAVQEHPRRNRMILVLVTFPLMRRKSSTVLMKMMSALSQVKESLTHWKINRMKIME

SEQ ID NO: 33217 - protein, 133 aa, Homo sapiens
  Payload ID: 6522
  Gene Symbol: FGD6
  Gene Name: FYVE, RhoGEF and PH domain containing 6
  ENSP ID: ENSP00000448350
  MOD_RES (1)..(1): Any amino acid
XNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEVDRSISGRHNIVAVLVSSLL

SEQ ID NO: 33218 - protein, 1206 aa, Homo sapiens
  Payload ID: 6522
  Gene Symbol: FGD6
  Gene Name: FYVE, RhoGEF and PH domain containing 6
  ENSP ID: ENSP00000449005
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENK

SEQ ID NO: 33219 - protein, 279 aa, Homo sapiens
  Payload ID: 6522
  Gene Symbol: FGD6
  Gene Name: FYVE, RhoGEF and PH domain containing 6
  ENSP ID: ENSP00000450240
MLQLRPQVILNCLRRSRPCSLCQDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKL

SEQ ID NO: 33220 - protein, 1374 aa, Homo sapiens
  Payload ID: 6522
  Gene Symbol: FGD6
  Gene Name: FYVE, RhoGEF and PH domain containing 6
  Uniprot ID: Q6ZV73
  ENSP ID: ENSP00000450342
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEVRSEI

SEQ ID NO: 33221 - protein, 117 aa, Homo sapiens
  Payload ID: 6523
  Gene Symbol: GAGE1
  Gene Name: G antigen 1
  Uniprot ID: Q13068
  ENSP ID: ENSP00000371119
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEGQSQC

SEQ ID NO: 33222 - protein, 139 aa, Homo sapiens
  Payload ID: 6523
  Gene Symbol: GAGE1
  Gene Name: G antigen 1
  Uniprot ID: Q13065
  ENSP ID: ENSP00000371128
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEEMRSHYVAQTGILWLLMNNCFLNLSPRKP

SEQ ID NO: 33223 - protein, 117 aa, Homo sapiens; identical to SEQ ID NO: 33221
  Payload ID: 6523
  Gene Symbol: GAGE1
  Gene Name: G antigen 1
  Uniprot ID: Q13068
  ENSP ID: ENSP00000482230

SEQ ID NO: 33224 - protein, 117 aa, Homo sapiens; identical to SEQ ID NO: 33221
  Payload ID: 6523
  Gene Symbol: GAGE1
  Gene Name: G antigen 1
  Uniprot ID: Q13068
  ENSP ID: ENSP00000484668

SEQ ID NO: 33225 - protein, 116 aa, Homo sapiens
  Payload ID: 6524
  Gene Symbol: GAGE10
  Gene Name: G antigen 10
  Uniprot ID: A6NGK3
  ENSP ID: ENSP00000385415
MSWRGRSTYRPRPRRYVEPPEMIGPMLPEQFSDEVEPATPEEGEPATQRQDPAAAQEGEDEGASAGQGPKPEADSQEQVHPKTGCECGDGPDGQEMGLPNPEEVKRPEEGEKQSQC

SEQ ID NO: 33226 - protein, 7 aa, Homo sapiens
  Payload ID: 6525
  Gene Symbol: GAGE12B
  Gene Name: G antigen 12B
  ENSP ID: ENSP00000354603
  MOD_RES (1)..(1): Any amino acid
XEKQSQC

SEQ ID NO: 33227 - protein, 117 aa, Homo sapiens
  Payload ID: 6526
  Gene Symbol: GAGE12C
  Gene Name: G antigen 12C
  Uniprot ID: A1L429
  ENSP ID: ENSP00000397103
MSWRGRSTYYWPRPRRYVQPPEMIGPMRPEQFSDEVEPATPEEGEPATQCQDPAAAQEGEDEGASAGQGPKPEAHSQEQGHPQTGCECEDGPDGQEMDPPNPEEVKTPEEGEKQSQC

SEQ ID NO: 33228 - protein, 117 aa, Homo sapiens; identical to SEQ ID NO: 33227
  Payload ID: 6527
  Gene Symbol: GAGE12D
  Gene Name: G antigen 12D
  Uniprot ID: A1L429
  ENSP ID: ENSP00000384214

SEQ ID NO: 33229 - protein, 117 aa, Homo sapiens; identical to SEQ ID NO: 33227
  Payload ID: 6528
  Gene Symbol: GAGE12E
  Gene Name: G antigen 12E
  Uniprot ID: A1L429
  ENSP ID: ENSP00000371117

SEQ ID NO: 33230 - protein, 117 aa, Homo sapiens
  Payload ID: 6529
  Gene Symbol: GAGE12F
  Gene Name: G antigen 12F
  Uniprot ID: P0CL80
  ENSP ID: ENSP00000404123
MSWRGRSTYYWPRPRRYVQPPEMIGPMRPEQFSDEVEPATPEEGEPATQRQDPAAAQEGEDEGASAGQGPKPEAHSQEQGHPQTGCECEDGPDGQEMDPPNPEEVKTPEEGEKQSQC

SEQ ID NO: 33231 - protein, 117 aa, Homo sapiens; identical to SEQ ID NO: 33230
  Payload ID: 6530
  Gene Symbol: GAGE12G
  Gene Name: G antigen 12G
  Uniprot ID: P0CL81
  ENSP ID: ENSP00000416249

SEQ ID NO: 33232 - protein, 117 aa, Homo sapiens
  Payload ID: 6531
  Gene Symbol: GAGE12H
  Gene Name: G antigen 12H
  Uniprot ID: A6NDE8
  ENSP ID: ENSP00000371141
MSWRGRSTYYWPRPRRYVQPPEMIGPMRPEQFSDEVEPATPEEGEPATQCQDPAAAQKGEDEGASAGQGPKPEAHSQEQGHPQTGCECEDGPDGQEMDPPNPEEVKTPEEGEKQSQC

SEQ ID NO: 33233 - protein, 117 aa, Homo sapiens
  Payload ID: 6532
  Gene Symbol: GAGE12J
  Gene Name: G antigen 12J
  Uniprot ID: A6NER3
  ENSP ID: ENSP00000409832
MSWRGRSTYYWPRPRPYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 33234 - protein, 117 aa, Homo sapiens
  Payload ID: 6533
  Gene Symbol: GAGE13
  Gene Name: G antigen 13
  ENSP ID: ENSP00000483811
MSWRGRSTYYWPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 33235 - protein, 116 aa, Homo sapiens
  Payload ID: 6534
  Gene Symbol: GAGE2A
  Gene Name: G antigen 2A
  Uniprot ID: Q6NT46
  ENSP ID: ENSP00000355421
MSWRGRSTYRPRPRRYVEPPEMIGPMRPEQFSDEVEPATPEEGEPATQRQDPAAAQEGQDEGASAGQGPKPEAHSQEQGHPQTGCECEDGPDGQEMDPPNPEEVKTPEEGEKQSQC

SEQ ID NO: 33236 - protein, 110 aa, Homo sapiens
  Payload ID: 6535
  Gene Symbol: GAGE2E
  Gene Name: G antigen 2E
  ENSP ID: ENSP00000478568
MSWRGRSTYYWPRPRRYVQPPEMIGPMRPEQFSDEVEPATPEEGEPATQRQDPAAAQEGEDEGASAGQGPKPEAHSQEQGHPQTGCECEDGPDGQEMDPPNPEEVKTPEE

SEQ ID NO: 33237 - protein, 770 aa, Homo sapiens
  Payload ID: 6536
  Gene Symbol: GFM1
  Gene Name: G elongation factor, mitochondrial 1
  Uniprot ID: Q96RP9
  ENSP ID: ENSP00000264263
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGHFLRDFLPLLWNWDRRSGSQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDDSKEKTKILMNSSRDNSHPFVGLAFKLEVGRFGQLTYVRSYQGELKKGDTIYNTRTRKKVRLQRLARMHADMMEDVEEVYAGDICALFGIDCASGDTFTDKANSGLSMESIHVPDPVISIAMKPSNKNDLEKFSKGIGRFTREDPTFKVYFDTENKETVISGMGELHLEIYAQRLEREYGCPCITGKPKVAFRETITAPVPFDFTHKKQSGGAGQYGKVIGVLEPLDPEDYTKLEFSDETFGSNIPKQFVPAVEKGFLDACEKGPLSGHKLSGLRFVLQDGAHHMVDSNEISFIRAGEGALKQALANATLCILEPIMAVEVVAPNEFQGQVIAGINRRHGVITGQDGVEDYFTLYADVPLNDMFGYSTELRSCTEGKGEYTMEYSRYQPCLPSTQEDVINKYLEATGQLPVKKGKAKN

SEQ ID NO: 33238 - protein, 453 aa, Homo sapiens
  Payload ID: 6536
  Gene Symbol: GFM1
  Gene Name: G elongation factor, mitochondrial 1
  ENSP ID: ENSP00000417225
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKATIRRATLKRSFTPVFLGSALKNKGVQPLLDAVLEYLPNPSEVQNYAILNKEDDSKEKTKILMNSSRDNSHPFVGLAFKLEVGRFGQLTYVRSYQGELKKGDTIYNTRTRKKVRLQRLARMHADMMEASTEKYMPETSVHCLALTVLVETHSQTKPTAAFLWSQFMFLILSFQ

SEQ ID NO: 33239 - protein, 60 aa, Homo sapiens
  Payload ID: 6536
  Gene Symbol: GFM1
  Gene Name: G elongation factor, mitochondrial 1
  ENSP ID: ENSP00000417532
MHEVKGKDGVGAVMDSMELERQRGITIQSAATYTMWKDVNINIIDTPGHVDFTIEVERAL

SEQ ID NO: 33240 - protein, 591 aa, Homo sapiens
  Payload ID: 6536
  Gene Symbol: GFM1
  Gene Name: G elongation factor, mitochondrial 1
  ENSP ID: ENSP00000418755
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDDSKEKTKILMNSSRDNSHPFVGLAFKLEVGRFGQLTYVRSYQGELKKGDTIYNTRTRKKVRLQRLARMHADMMEDVEEVYAGDICALFGIDCASGDTFTDKANSGLSMESIHVPDPVISIAMKPSNKNDLEKFSKGIGRFTREDPTFKVYFDTENKETVISGMGELHLEIYAQRLEREYGCPCITGKPKVAFRETITAPVPFDFTHKKQSGGAGQYGKVIGVLEPLDPEDYTKLEFSDETFGSNIPKQFVPAVEKVNF

SEQ ID NO: 33241 - protein, 751 aa, Homo sapiens
  Payload ID: 6536
  Gene Symbol: GFM1
  Gene Name: G elongation factor, mitochondrial 1
  Uniprot ID: Q96RP9
  ENSP ID: ENSP00000419038
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDDSKEKTKILMNSSRDNSHPFVGLAFKLEVGRFGQLTYVRSYQGELKKGDTIYNTRTRKKVRLQRLARMHADMMEDVEEVYAGDICALFGIDCASGDTFTDKANSGLSMESIHVPDPVISIAMKPSNKNDLEKFSKGIGRFTREDPTFKVYFDTENKETVISGMGELHLEIYAQRLEREYGCPCITGKPKVAFRETITAPVPFDFTHKKQSGGAGQYGKVIGVLEPLDPEDYTKLEFSDETFGSNIPKQFVPAVEKGFLDACEKGPLSGHKLSGLRFVLQDGAHHMVDSNEISFIRAGEGALKQALANATLCILEPIMAVEVVAPNEFQGQVIAGINRRHGVITGQDGVEDYFTLYADVPLNDMFGYSTELRSCTEGKGEYTMEYSRYQPCLPSTQEDVINKYLEATGQLPVKKGKAKN

SEQ ID NO: 33242 - protein, 17 aa, Homo sapiens
  Payload ID: 6536
  Gene Symbol: GFM1
  Gene Name: G elongation factor, mitochondrial 1
  ENSP ID: ENSP00000420272
  MOD_RES (1)..(1): Any amino acid
XSFIRAGEGALKQGPSK

SEQ ID NO: 33243 - protein, 732 aa, Homo sapiens
  Payload ID: 6537
  Gene Symbol: GFM2
  Gene Name: G elongation factor, mitochondrial 2
  Uniprot ID: Q969S9
  ENSP ID: ENSP00000296804
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 33244 - protein, 779 aa, Homo sapiens
  Payload ID: 6537
  Gene Symbol: GFM2
  Gene Name: G elongation factor, mitochondrial 2
  Uniprot ID: Q969S9
  ENSP ID: ENSP00000296805
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 33245 - protein, 513 aa, Homo sapiens
  Payload ID: 6537
  Gene Symbol: GFM2
  Gene Name: G elongation factor, mitochondrial 2
  Uniprot ID: Q969S9
  ENSP ID: ENSP00000405808
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPGINGLSVSTN

SEQ ID NO: 33246 - protein, 285 aa, Homo sapiens
  Payload ID: 6537
  Gene Symbol: GFM2
  Gene Name: G elongation factor, mitochondrial 2
  ENSP ID: ENSP00000421717
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPV

SEQ ID NO: 33247 - protein, 64 aa, Homo sapiens
  Payload ID: 6537
  Gene Symbol: GFM2
  Gene Name: G elongation factor, mitochondrial 2
  ENSP ID: ENSP00000424877
MAHIDAGKTTTTERILYYSGYTRSLGDVDDGDTVTDFMAQERERGITIQSAAVTFDWKGYRVNL

SEQ ID NO: 33248 - protein, 779 aa, Homo sapiens; identical to SEQ ID NO: 33244
  Payload ID: 6537
  Gene Symbol: GFM2
  Gene Name: G elongation factor, mitochondrial 2
  Uniprot ID: Q969S9
  ENSP ID: ENSP00000427004

SEQ ID NO: 33249 - protein, 315 aa, Homo sapiens
  Payload ID: 6538
  Gene Symbol: GKAP1
  Gene Name: G kinase anchoring protein 1
  Uniprot ID: Q5VSY0
  ENSP ID: ENSP00000365544
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQLTSEMFEADLEKALLLSKLEYEEHKKEYEDAENTSTQSKVMNKKDKRKNHQGKDRPLTVSLKDFHSEDHISKKTEEVVLKDGRIERLKLELERKDAEIQKLKNVITQWEAKYKEVKARNAQLLKMLQEGEMKDKAEILLQVDESQSIKNELTIQVTSLHAALEQERSKVKVLQAELAKYQGGRKGKRNSESDQCR

SEQ ID NO: 33250 - protein, 366 aa, Homo sapiens
  Payload ID: 6538
  Gene Symbol: GKAP1
  Gene Name: G kinase anchoring protein 1
  Uniprot ID: Q5VSY0
  ENSP ID: ENSP00000365550
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQLTSEMFEADLEKALLLSKLEYEEHKKEYEDAENTSTQSKVMNKKDKRKNHQGKDRPLTVSLKDFHSEDHISKKTEELSSSQTLSHDGGFFNRLEDDVHKILIREKRREQLTEYNGTDNCTAHEHNQEVVLKDGRIERLKLELERKDAEIQKLKNVITQWEAKYKEVKARNAQLLKMLQEGEMKDKAEILLQVDESQSIKNELTIQVTSLHAALEQERSKVKVLQAELAKYQGGRKGKRNSESDQCR

SEQ ID NO: 33251 - protein, 126 aa, Homo sapiens
  Payload ID: 6538
  Gene Symbol: GKAP1
  Gene Name: G kinase anchoring protein 1
  ENSP ID: ENSP00000373434
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQMGSRRQ

SEQ ID NO: 33252 - protein, 54 aa, Homo sapiens
  Payload ID: 6538
  Gene Symbol: GKAP1
  Gene Name: G kinase anchoring protein 1
  ENSP ID: ENSP00000417621
MASAVLSSVPTTASRFALLQVDSGSGSDSEPGKGKGRNTGKSQTLGSKSTTNEK

SEQ ID NO: 33253 - protein, 356 aa, Homo sapiens
  Payload ID: 6539
  Gene Symbol: GPANK1
  Gene Name: G patch domain and ankyrin repeats 1
  Uniprot ID: O95872
  ENSP ID: ENSP00000211377
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRGGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 33254 - protein, 356 aa, Homo sapiens
  Payload ID: 6539
  Gene Symbol: GPANK1
  Gene Name: G patch domain and ankyrin repeats 1
  Uniprot ID: O95872
  ENSP ID: ENSP00000365057
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRGGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 33255 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000365059

SEQ ID NO: 33256 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000365060

SEQ ID NO: 33257 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000365065

SEQ ID NO: 33258 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000365071

SEQ ID NO: 33259 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000372926

SEQ ID NO: 33260 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000372928

SEQ ID NO: 33261 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000382994

SEQ ID NO: 33262 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000382999

SEQ ID NO: 33263 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000383005

SEQ ID NO: 33264 - protein, 198 aa, Homo sapiens
  Payload ID: 6539
  Gene Symbol: GPANK1
  Gene Name: G patch domain and ankyrin repeats 1
  ENSP ID: ENSP00000387492
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRE

SEQ ID NO: 33265 - protein, 356 aa, Homo sapiens
  Payload ID: 6539
  Gene Symbol: GPANK1
  Gene Name: G patch domain and ankyrin repeats 1
  ENSP ID: ENSP00000388586
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRRGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 33266 - protein, 356 aa, Homo sapiens; identical to SEQ ID NO: 33265
  Payload ID: 6539
  Gene Symbol: GPANK1
  Gene Name: G patch domain and ankyrin repeats 1
  ENSP ID: ENSP00000388687

SEQ ID NO: 33267 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000389339

SEQ ID NO: 33268 - protein, 356 aa, Homo sapiens; identical to SEQ ID NO: 33265
  Payload ID: 6539
  Gene Symbol: GPANK1
  Gene Name: G patch domain and ankyrin repeats 1
  ENSP ID: ENSP00000390293

SEQ ID NO: 33269 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000390746

SEQ ID NO: 33270 - protein, 152 aa, Homo sapiens
  Payload ID: 6539
  Gene Symbol: GPANK1
  Gene Name: G patch domain and ankyrin repeats 1
  ENSP ID: ENSP00000391161
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAAR

SEQ ID NO: 33271 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000391604

SEQ ID NO: 33272 - protein, 89 aa, Homo sapiens
  Payload ID: 6539
  Gene Symbol: GPANK1
  Gene Name: G patch domain and ankyrin repeats 1
  ENSP ID: ENSP00000391754
MSRPLLITFTPATDPSDLWKDGQQQPQPEKPESTLDGAAARAFYEALIGDESSAPDSQRSQTEPARERKRKKRRIMKAPAAEAVAEGAS

SEQ ID NO: 33273 - protein, 107 aa, Homo sapiens
  Payload ID: 6539
  Gene Symbol: GPANK1
  Gene Name: G patch domain and ankyrin repeats 1
  ENSP ID: ENSP00000392449
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHR

SEQ ID NO: 33274 - protein, 107 aa, Homo sapiens
  Payload ID: 6539
  Gene Symbol: GPANK1
  Gene Name: G patch domain and ankyrin repeats 1
  ENSP ID: ENSP00000392933
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHR

SEQ ID NO: 33275 - protein, 152 aa, Homo sapiens; identical to SEQ ID NO: 33270
  Payload ID: 6539
  Gene Symbol: GPANK1
  Gene Name: G patch domain and ankyrin repeats 1
  ENSP ID: ENSP00000393162

SEQ ID NO: 33276 - protein, 107 aa, Homo sapiens; identical to SEQ ID NO: 33273
  Payload ID: 6539
  Gene Symbol: GPANK1
  Gene Name: G patch domain and ankyrin repeats 1
  ENSP ID: ENSP00000393547

SEQ ID NO: 33277 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000393567

SEQ ID NO: 33278 - protein, 164 aa, Homo sapiens
  Payload ID: 6539
  Gene Symbol: GPANK1
  Gene Name: G patch domain and ankyrin repeats 1
  ENSP ID: ENSP00000395307
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLG

SEQ ID NO: 33279 - protein, 89 aa, Homo sapiens; identical to SEQ ID NO: 33272
  Payload ID: 6539
  Gene Symbol: GPANK1
  Gene Name: G patch domain and ankyrin repeats 1
  ENSP ID: ENSP00000395484

SEQ ID NO: 33280 - protein, 89 aa, Homo sapiens
  Payload ID: 6539
  Gene Symbol: GPANK1
  Gene Name: G patch domain and ankyrin repeats 1
  ENSP ID: ENSP00000398758
MSRPLLITFTPATDPSDLWKDGQQQPQPEKPESTLDGAAALAFYEALIGDESSAPDSQRSQTEPARERKRKKRRIMKAPAAEAVAEGAS

SEQ ID NO: 33281 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000398927

SEQ ID NO: 33282 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000399890

SEQ ID NO: 33283 - protein, 107 aa, Homo sapiens; identical to SEQ ID NO: 33273
  Payload ID: 6539
  Gene Symbol: GPANK1
  Gene Name: G patch domain and ankyrin repeats 1
  ENSP ID: ENSP00000400167

SEQ ID NO: 33284 - protein, 89 aa, Homo sapiens; identical to SEQ ID NO: 33280
  Payload ID: 6539
  Gene Symbol: GPANK1
  Gene Name: G patch domain and ankyrin repeats 1
  ENSP ID: ENSP00000400488

SEQ ID NO: 33285 - protein, 198 aa, Homo sapiens
  Payload ID: 6539
  Gene Symbol: GPANK1
  Gene Name: G patch domain and ankyrin repeats 1
  ENSP ID: ENSP00000400711
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRE

SEQ ID NO: 33286 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000401272

SEQ ID NO: 33287 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000401276

SEQ ID NO: 33288 - protein, 164 aa, Homo sapiens; identical to SEQ ID NO: 33278
  Payload ID: 6539
  Gene Symbol: GPANK1
  Gene Name: G patch domain and ankyrin repeats 1
  ENSP ID: ENSP00000401352

SEQ ID NO: 33289 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000401376

SEQ ID NO: 33290 - protein, 164 aa, Homo sapiens; identical to SEQ ID NO: 33278
  Payload ID: 6539
  Gene Symbol: GPANK1
  Gene Name: G patch domain and ankyrin repeats 1
  ENSP ID: ENSP00000402133

SEQ ID NO: 33291 - protein, 107 aa, Homo sapiens; identical to SEQ ID NO: 33274
  Payload ID: 6539
  Gene Symbol: GPANK1
  Gene Name: G patch domain and ankyrin repeats 1
  ENSP ID: ENSP00000403719

SEQ ID NO: 33292 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000403829

SEQ ID NO: 33293 - protein, 152 aa, Homo sapiens
  Payload ID: 6539
  Gene Symbol: GPANK1
  Gene Name: G patch domain and ankyrin repeats 1
  ENSP ID: ENSP00000404544
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAAR

SEQ ID NO: 33294 - protein, 89 aa, Homo sapiens; identical to SEQ ID NO: 33272
  Payload ID: 6539
  Gene Symbol: GPANK1
  Gene Name: G patch domain and ankyrin repeats 1
  ENSP ID: ENSP00000404929

SEQ ID NO: 33295 - protein, 164 aa, Homo sapiens
  Payload ID: 6539
  Gene Symbol: GPANK1
  Gene Name: G patch domain and ankyrin repeats 1
  ENSP ID: ENSP00000405625
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLG

SEQ ID NO: 33296 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000406507

SEQ ID NO: 33297 - protein, 107 aa, Homo sapiens; identical to SEQ ID NO: 33274
  Payload ID: 6539
  Gene Symbol: GPANK1
  Gene Name: G patch domain and ankyrin repeats 1
  ENSP ID: ENSP00000406761

SEQ ID NO: 33298 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000406895

SEQ ID NO: 33299 - protein, 89 aa, Homo sapiens; identical to SEQ ID NO: 33280
  Payload ID: 6539
  Gene Symbol: GPANK1
  Gene Name: G patch domain and ankyrin repeats 1
  ENSP ID: ENSP00000407932

SEQ ID NO: 33300 - protein, 164 aa, Homo sapiens; identical to SEQ ID NO: 33278
  Payload ID: 6539
  Gene Symbol: GPANK1
  Gene Name: G patch domain and ankyrin repeats 1
  ENSP ID: ENSP00000408034

SEQ ID NO: 33301 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000409206

SEQ ID NO: 33302 - protein, 164 aa, Homo sapiens; identical to SEQ ID NO: 33295
  Payload ID: 6539
  Gene Symbol: GPANK1
  Gene Name: G patch domain and ankyrin repeats 1
  ENSP ID: ENSP00000409320

SEQ ID NO: 33303 - protein, 152 aa, Homo sapiens; identical to SEQ ID NO: 33270
  Payload ID: 6539
  Gene Symbol: GPANK1
  Gene Name: G patch domain and ankyrin repeats 1
  ENSP ID: ENSP00000409349

SEQ ID NO: 33304 - protein, 356 aa, Homo sapiens; identical to SEQ ID NO: 33265
  Payload ID: 6539
  Gene Symbol: GPANK1
  Gene Name: G patch domain and ankyrin repeats 1
  ENSP ID: ENSP00000409855

SEQ ID NO: 33305 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000410690

SEQ ID NO: 33306 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000411691

SEQ ID NO: 33307 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000412321

SEQ ID NO: 33308 - protein, 198 aa, Homo sapiens; identical to SEQ ID NO: 33264
  Payload ID: 6539
  Gene Symbol: GPANK1
  Gene Name: G patch domain and ankyrin repeats 1
  ENSP ID: ENSP00000412339

SEQ ID NO: 33309 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000412884

SEQ ID NO: 33310 - protein, 198 aa, Homo sapiens; identical to SEQ ID NO: 33264
  Payload ID: 6539
  Gene Symbol: GPANK1
  Gene Name: G patch domain and ankyrin repeats 1
  ENSP ID: ENSP00000413534

SEQ ID NO: 33311 - protein, 152 aa, Homo sapiens; identical to SEQ ID NO: 33270
  Payload ID: 6539
  Gene Symbol: GPANK1
  Gene Name: G patch domain and ankyrin repeats 1
  ENSP ID: ENSP00000413618

SEQ ID NO: 33312 - protein, 356 aa, Homo sapiens; identical to SEQ ID NO: 33253
  Payload ID: 6539
  Gene Symbol: GPANK1
  Gene Name: G patch domain and ankyrin repeats 1
  Uniprot ID: O95872
  ENSP ID: ENSP00000413662

SEQ ID NO: 33313 - protein, 198 aa, Homo sapiens; identical to SEQ ID NO: 33285
  Payload ID: 6539
  Gene Symbol: GPANK1
  Gene Name: G patch domain and ankyrin repeats 1
  ENSP ID: ENSP00000413683

SEQ ID NO: 33314 - protein, 89 aa, Homo sapiens; identical to SEQ ID NO: 33272
  Payload ID: 6539
  Gene Symbol: GPANK1
  Gene Name: G patch domain and ankyrin repeats 1
  ENSP ID: ENSP00000413733

SEQ ID NO: 33315 - protein, 152 aa, Homo sapiens; identical to SEQ ID NO: 33293
  Payload ID: 6539
  Gene Symbol: GPANK1
  Gene Name: G patch domain and ankyrin repeats 1
  ENSP ID: ENSP00000413983

SEQ ID NO: 33316 - protein, 356 aa, Homo sapiens; identical to SEQ ID NO: 33265
  Payload ID: 6539
  Gene Symbol: GPANK1
  Gene Name: G patch domain and ankyrin repeats 1
  ENSP ID: ENSP00000414105

SEQ ID NO: 33317 - protein, 356 aa, Homo sapiens; identical to SEQ ID NO: 33254
  Payload ID: 6539
  Gene Symbol: GPANK1
  Gene Name: G patch domain and ankyrin repeats 1
  Uniprot ID: O95872
  ENSP ID: ENSP00000415855

SEQ ID NO: 33318 - protein, 164 aa, Homo sapiens; identical to SEQ ID NO: 33295
  Payload ID: 6539
  Gene Symbol: GPANK1
  Gene Name: G patch domain and ankyrin repeats 1
  ENSP ID: ENSP00000415884

SEQ ID NO: 33319 - protein, 152 aa, Homo sapiens; identical to SEQ ID NO: 33293
  Payload ID: 6539
  Gene Symbol: GPANK1
  Gene Name: G patch domain and ankyrin repeats 1
  ENSP ID: ENSP00000416056

SEQ ID NO: 33320 - protein, 198 aa, Homo sapiens; identical to SEQ ID NO: 33285
  Payload ID: 6539
  Gene Symbol: GPANK1
  Gene Name: G patch domain and ankyrin repeats 1
  ENSP ID: ENSP00000416184

SEQ ID NO: 33321 - protein, 476 aa, Homo sapiens
  Payload ID: 6540
  Gene Symbol: GPKOW
  Gene Name: G patch domain and KOW motifs
  Uniprot ID: Q92917
  ENSP ID: ENSP00000156109
MADSKEGVLPLTAASTAPISFGFTRTSARRRLADSGDGAGPSPEEKDFLKTVEGRELQSVKPQEAPKELVIPLIQNGHRRQPPARPPGPSTDTGALADGVVSQAVKELIAESKKSLEERENAGVDPTLAIPMIQKGCTPSGEGADSEPRAETVPEEANYEAVPVEAYGLAMLRGMGWKPGEGIGRTFNQVVKPRVNSLRPKGLGLGANLTEAQALTPTGPSRMPRPDEEQEKDKEDQPQGLVPGGAVVVLSGPHRGLYGKVEGLDPDNVRAMVRLAVGSRVVTVSEYYLRPVSQQEFDKNTLDLRQQNGTASSRKTLWNQELYIQQDNSERKRKHLPDRQDGPAAKSEKAAPRSQHWLHRDLRVRFVDNMYKGGQYYNTKMIIEDVLSPDTCVCRTDEGRVLEGLREDMLETLVPKAEGDRVMVVLGPQTGRVGHLLSRDRARSRALVQLPRENQVVELHYDAICQYMGPSDTDDD

SEQ ID NO: 33322 - protein, 931 aa, Homo sapiens
  Payload ID: 6541
  Gene Symbol: GPATCH1
  Gene Name: G patch domain containing 1
  Uniprot ID: Q9BRR8
  ENSP ID: ENSP00000170564
MAARDSDSEEDLVSYGTGLEPLEEGERPKKPIPLQDQTVRDEKGRYKRFHGAFSGGFSAGYFNTVGSKEGWTPSTFVSSRQNRADKSVLGPEDFMDEEDLSEFGIAPKAIVTTDDFASKTKDRIREKARQLAAATAPIPGATLLDDLITPAKLSVGFELLRKMGWKEGQGVGPRVKRRPRRQKPDPGVKIYGCALPPGSSEGSEGEDDDYLPDNVTFAPKDVTPVDFTPKDNVHGLAYKGLDPHQALFGTSGEHFNLFSGGSERAGDLGEIGLNKGRKLGISGQAFGVGALEEEDDDIYATETLSKYDTVLKDEEPGDGLYGWTAPRQYKNQKESEKDLRYVGKILDGFSLASKPLSSKKIYPPPELPRDYRPVHYFRPMVAATSENSHLLQVLSESAGKATPDPGTHSKHQLNASKRAELLGETPIQGSATSVLEFLSQKDKERIKEMKQATDLKAAQLKARSLAQNAQSSRAQLSPAAAAGHCSWNMALGGGTATLKASNFKPFAKDPEKQKRYDEFLVHMKQGQKDALERCLDPSMTEWERGRERDEFARAALLYASSHSTLSSRFTHAKEEDDSDQVEVPRDQENDVGDKQSAVKMKMFGKLTRDTFEWHPDKLLCKRFNVPDPYPDSTLVGLPRVKRDKYSVFNFLTLPETASLPTTQASSEKVSQHRGPDKSRKPSRWDTSKHEKKEDSISEFLSLARSKAEPPKQQSSPLVNKEEEHAPELSANQTVNKDVDAQAEGEGSRPSMDLFRAIFASSSDEKSSSSEDEQGDSEDDQAGSGEANFQSSQDTDLGETSSVAHALVPAPQEPPPSFPIQKMQIDEREEFGPRLPPVFCPNARQTLEVPQKEKHKKNKDKHKAKKEHRRKKEKKKKHRKHKHKGKQKNKKPEKSSSSESSDSSDSQSDEETADVSPQELLRRLKSLPLRRQ

SEQ ID NO: 33323 - protein, 128 aa, Homo sapiens
  Payload ID: 6541
  Gene Symbol: GPATCH1
  Gene Name: G patch domain containing 1
  ENSP ID: ENSP00000467632
MAARDSDSEEDLVSYGTGLEPLEEGERPKKPIPLQDQTVRDEKGRYKRFHGAFSGGFSAGYFNTVGSKEGWTPSTFVSSRQNRADKSVLGPEDFMDEEILESKSMAVHYPLEARKDLRVKMMTTCLIM

SEQ ID NO: 33324 - protein, 156 aa, Homo sapiens
  Payload ID: 6542
  Gene Symbol: GPATCH11
  Gene Name: G patch domain containing 11
  Uniprot ID: Q8N954
  ENSP ID: ENSP00000281932
MSRKSGIGHEASLKRKAEEKLESYRKKIHMKNQAEEKAAEQFRMRLKNKQDEMKLEGDLRRSQRACQQLDVQKNIQVPREAWYWLRLEEETEEDEEEKEQDEDEYKSEDLSVLEKLQILTSYLREEHLYCIWCGTAYEDKEDLSSNCPGPTSADHD

SEQ ID NO: 33325 - protein, 285 aa, Homo sapiens
  Payload ID: 6542
  Gene Symbol: GPATCH11
  Gene Name: G patch domain containing 11
  ENSP ID: ENSP00000386772
MRSARSTALNRGEQRAVRYYSHMKLNMAEEEDYMSDSFINVQEDIRPGLPMLRQIREARRKEEKQQEANLKNRQKSLKEEEQERRDIGLKNALGCENKGFALLQKMGYKSGQALGKSGGGIVEPIPLNIKTGKSGIGHEASLKRKAEEKLESYRKKIHMKNQAEEKAAEQFRMRLKNKQDEMKLEGDLRRSQRACQQLDVQKNIQVPREAWYWLRLEEETEEDEEEKEQDEDEYKSEDLSVLEKLQILTSYLREEHLYCIWCGTAYEDKEDLSSNCPGPTSADHD

SEQ ID NO: 33326 - protein, 376 aa, Homo sapiens
  Payload ID: 6543
  Gene Symbol: GPATCH2
  Gene Name: G patch domain containing 2
  Uniprot ID: Q9NW75
  ENSP ID: ENSP00000355901
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVAKRRPSSNLNNNVRGKRPLWHESDFAVDNVGNRTLRRRRKVKRMAVDLPQDISNKRTMTQPPEGCRDQDMDSDRAYQYQEFTKNKVKKRKLKIIRQGPKIQDEGVVLESEETNQTNKDKMECEEQKVSDELMSESDSSSLSSTDAGLFTNDEGRQGDDEQSDWFYEKESGGACGITGVVPWWEKEDPTELDKNVPDPVFESILTGSFPLMSHPSRRGFQARLSRLHGMSSKNIKKSGGTPTSMATNWTSEIPL

SEQ ID NO: 33327 - protein, 528 aa, Homo sapiens
  Payload ID: 6543
  Gene Symbol: GPATCH2
  Gene Name: G patch domain containing 2
  Uniprot ID: Q9NW75
  ENSP ID: ENSP00000355902
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVAKRRPSSNLNNNVRGKRPLWHESDFAVDNVGNRTLRRRRKVKRMAVDLPQDISNKRTMTQPPEGCRDQDMDSDRAYQYQEFTKNKVKKRKLKIIRQGPKIQDEGVVLESEETNQTNKDKMECEEQKVSDELMSESDSSSLSSTDAGLFTNDEGRQGDDEQSDWFYEKESGGACGITGVVPWWEKEDPTELDKNVPDPVFESILTGSFPLMSHPSRRGFQARLSRLHGMSSKNIKKSGGTPTSMVPIPGPVGNKRMVHFSPDSHHHDHWFSPGARTEHDQHQLLRDNRAERGHKKNCSVRTASRQTSMHLGSLCTGDIKRRRKAAPLPGPTTAGFVGENAQPILENNIGNRMLQNMGWTPGSGLGRDGKGISEPIQAMQRPKGLGLGFPLPKSTSATTTPNAGKSA

SEQ ID NO: 33328 - protein, 482 aa, Homo sapiens
  Payload ID: 6544
  Gene Symbol: GPATCH2L
  Gene Name: G patch domain containing 2-like
  Uniprot ID: Q9NWQ4
  ENSP ID: ENSP00000261530
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKETSINTLGTERISHIISDPRQKEKNKALASDFPHISACAHEFNPLSPLYSLDVLADASHRRCSPAHCSARQANVHWGPPCSRDIKRKRKPVATASLSSPSAVHMDAVEPTTPASQAPKSPSSEWLVRTSAAEKATDATTATFFKMPQEKSPGYS

SEQ ID NO: 33329 - protein, 477 aa, Homo sapiens
  Payload ID: 6544
  Gene Symbol: GPATCH2L
  Gene Name: G patch domain containing 2-like
  Uniprot ID: Q9NWQ4
  ENSP ID: ENSP00000323775
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKETSINTLGTERISHIISDPRQKDFWLPSAGKRERNQFNPLSPLYSLDVLADASHRRCSPAHCSARQANVHWGPPCSRDIKRKRKPVATASLSSPSAVHMDAVEPTTPASQAPKSPSSEWLVRTSAAEKATDATTATFFKMPQEKSPGYS

SEQ ID NO: 33330 - protein, 61 aa, Homo sapiens
  Payload ID: 6544
  Gene Symbol: GPATCH2L
  Gene Name: G patch domain containing 2-like
  ENSP ID: ENSP00000450499
MGSSRVLLSLLLELQALRQERILHRHSTASCLMTSFHVQVCAVLPEVFICSFVFVFCIFVA

SEQ ID NO: 33331 - protein, 164 aa, Homo sapiens
  Payload ID: 6544
  Gene Symbol: GPATCH2L
  Gene Name: G patch domain containing 2-like
  ENSP ID: ENSP00000450521
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKENTPWTSSGHGLCESAENRTFLSKTGRKERMEC

SEQ ID NO: 33332 - protein, 351 aa, Homo sapiens
  Payload ID: 6544
  Gene Symbol: GPATCH2L
  Gene Name: G patch domain containing 2-like
  Uniprot ID: Q9NWQ4
  ENSP ID: ENSP00000450657
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKVIPLTVSLAQWGDNIPYGSCVSY

SEQ ID NO: 33333 - protein, 55 aa, Homo sapiens
  Payload ID: 6544
  Gene Symbol: GPATCH2L
  Gene Name: G patch domain containing 2-like
  ENSP ID: ENSP00000451325
MFLPMLLTEGVHQHTALPDRQMYTGDHHVHVTSRGSGNQWPQHLCLAPVQVITCS

SEQ ID NO: 33334 - protein, 351 aa, Homo sapiens; identical to SEQ ID NO: 33332
  Payload ID: 6544
  Gene Symbol: GPATCH2L
  Gene Name: G patch domain containing 2-like
  Uniprot ID: Q9NWQ4
  ENSP ID: ENSP00000451587

SEQ ID NO: 33335 - protein, 31 aa, Homo sapiens
  Payload ID: 6544
  Gene Symbol: GPATCH2L
  Gene Name: G patch domain containing 2-like
  ENSP ID: ENSP00000451827
  MOD_RES (1)..(1): Any amino acid
XSRDIKRKRKPVATASLSSPSAGGRRTAPLP

SEQ ID NO: 33336 - protein, 100 aa, Homo sapiens
  Payload ID: 6544
  Gene Symbol: GPATCH2L
  Gene Name: G patch domain containing 2-like
  ENSP ID: ENSP00000451868
MFLPMLLTEGVHQHTALPDRQMYTGDHHVHVTSRGSGNQWPQHLCLAPVQVITCSYHLLSMYRVPGTKLCVLYTFSCNVCDSVGHFIPTLHGKTETTRNN

SEQ ID NO: 33337 - protein, 365 aa, Homo sapiens
  Payload ID: 6544
  Gene Symbol: GPATCH2L
  Gene Name: G patch domain containing 2-like
  ENSP ID: ENSP00000452180
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKETSINTLGTERISHIISDPRQKDFWLPSAGKRERNQF

SEQ ID NO: 33338 - protein, 106 aa, Homo sapiens
  Payload ID: 6544
  Gene Symbol: GPATCH2L
  Gene Name: G patch domain containing 2-like
  ENSP ID: ENSP00000452294
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKS

SEQ ID NO: 33339 - protein, 477 aa, Homo sapiens; identical to SEQ ID NO: 33329
  Payload ID: 6544
  Gene Symbol: GPATCH2L
  Gene Name: G patch domain containing 2-like
  Uniprot ID: Q9NWQ4
  ENSP ID: ENSP00000480608

SEQ ID NO: 33340 - protein, 525 aa, Homo sapiens
  Payload ID: 6545
  Gene Symbol: GPATCH3
  Gene Name: G patch domain containing 3
  Uniprot ID: Q96I76
  ENSP ID: ENSP00000354645
MAVPGEAEEEATVYLVVSGIPSVLRSAHLRSYFSQFREERGGGFLCFHYRHRPERAPPQAAPNSALIPTDPAAEGQLLSQTSATDVRPLSTRDSTPIQTRTCCCVISVRGLAQAQRLIRMYSGRRWLDSHGTWLPGRCLIRRLRLPTEASGLGSFPFKTRKELQSWKAENEAFTLADLKQLPELNPPVLMPRGNVGTPLRVFLELIRACRLPPRIITQLQLQFPKTGSSRRYGNVPFEYEDSETVEQEELVYTAEGEEIPQGTYLADIPASPCGEPEEEVGKEEEEESHSDEDDDRGEEWERHEALHEDVTGQERTTEQLFEEEIELKWEKGGSGLVFYTDAQFWQEEEGDFDEQTADDWDVDMSVYYDRDGGDKDARDSVQMRLEQRLRDGQEDGSVIERQVGTFERHTKGIGRKVMERQGWAEGQGLGCRCSGVPEALDSDGQHPRCKRGLGYHGEKLQPFGQLKRPRRNGLGLISTIYDEPLPQDQTESLLRRQPPTSMKFRTDMAFVRGSSCASDSPSLPD

SEQ ID NO: 33341 - protein, 76 aa, Homo sapiens
  Payload ID: 6545
  Gene Symbol: GPATCH3
  Gene Name: G patch domain containing 3
  ENSP ID: ENSP00000398563
  MOD_RES (1)..(1): Any amino acid
XFDEQTADDWDVDMSVYYDRDGGDKDARDSVQMRLEQRLRDGQEDGSVIERQVGTFERHTKGIFTKSPLPSPPLGY

SEQ ID NO: 33342 - protein, 128 aa, Homo sapiens
  Payload ID: 6545
  Gene Symbol: GPATCH3
  Gene Name: G patch domain containing 3
  ENSP ID: ENSP00000399036
MRLEQRLRDGQEDGSVIERQVGTFERHTKGIGRKVMERQGWAEGQGLGCRCSGVPEALDSDGQHPRCKRGLGYHGEKLQPFGQLKRPRRNGLGLISTIYDEPLPQDQTESLLRRQPPTSMKFRTDMAF

SEQ ID NO: 33343 - protein, 370 aa, Homo sapiens
  Payload ID: 6546
  Gene Symbol: GPATCH4
  Gene Name: G patch domain containing 4
  ENSP ID: ENSP00000357215
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETFRWWNQGSREQSMQ

SEQ ID NO: 33344 - protein, 375 aa, Homo sapiens
  Payload ID: 6546
  Gene Symbol: GPATCH4
  Gene Name: G patch domain containing 4
  ENSP ID: ENSP00000396441
MFPRSGPSNDEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETFRWWNQGSREQSMQ

SEQ ID NO: 33345 - protein, 264 aa, Homo sapiens
  Payload ID: 6546
  Gene Symbol: GPATCH4
  Gene Name: G patch domain containing 4
  ENSP ID: ENSP00000412620
MNVTPEVKSRGMKFAEEQLLKHGWTQGKGLGRKENGITQALRVTLKQDTHGVGHDPAKEFTNHWWNELFNKTAANLVVETGQMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKK

SEQ ID NO: 33346 - protein, 119 aa, Homo sapiens
  Payload ID: 6546
  Gene Symbol: GPATCH4
  Gene Name: G patch domain containing 4
  ENSP ID: ENSP00000436243
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKTAQTLSRN

SEQ ID NO: 33347 - protein, 143 aa, Homo sapiens
  Payload ID: 6546
  Gene Symbol: GPATCH4
  Gene Name: G patch domain containing 4
  ENSP ID: ENSP00000436907
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKWDPVTSLAVAYLDCPDPQQELRSSGSVDPAIC

SEQ ID NO: 33348 - protein, 46 aa, Homo sapiens
  Payload ID: 6547
  Gene Symbol: GPATCH8
  Gene Name: G patch domain containing 8
  ENSP ID: ENSP00000464815
MADRFSRFNEDRDFQGNHFDQYEEGHLEIEQASLDKPIESQLAHIS

SEQ ID NO: 33349 - protein, 221 aa, Homo sapiens
  Payload ID: 6547
  Gene Symbol: GPATCH8
  Gene Name: G patch domain containing 8
  ENSP ID: ENSP00000465781
MADRFSRFNEDRDFQDNIGHRLLQKHGWKLGQGLGKSLQGRTDPIPIVVKYDVMGMGRMEMELDYAEDATERRRVLEVEKEDTEELRQKYKDYVDKEKAIAKALEDLRANFYCELCDKQYQKHQEFDNHINSYDHAHKQRLKDLKQREFARNVSSRSRKDEKKQEKALRRLHELAEQRKQAECAPGSGPMFKPTTVAVDEEGGEDDKDESATNSGTGATAS

SEQ ID NO: 33350 - protein, 46 aa, Homo sapiens; identical to SEQ ID NO: 33348
  Payload ID: 6547
  Gene Symbol: GPATCH8
  Gene Name: G patch domain containing 8
  ENSP ID: ENSP00000467233

SEQ ID NO: 33351 - protein, 1502 aa, Homo sapiens
  Payload ID: 6547
  Gene Symbol: GPATCH8
  Gene Name: G patch domain containing 8
  Uniprot ID: Q9UKJ3
  ENSP ID: ENSP00000467556
MADRFSRFNEDRDFQGNHFDQYEEGHLEIEQASLDKPIESDNIGHRLLQKHGWKLGQGLGKSLQGRTDPIPIVVKYDVMGMGRMEMELDYAEDATERRRVLEVEKEDTEELRQKYKDYVDKEKAIAKALEDLRANFYCELCDKQYQKHQEFDNHINSYDHAHKQRLKDLKQREFARNVSSRSRKDEKKQEKALRRLHELAEQRKQAECAPGSGPMFKPTTVAVDEEGGEDDKDESATNSGTGATASCGLGSEFSTDKGGPFTAVQITNTTGLAQAPGLASQGISFGIKNNLGTPLQKLGVSFSFAKKAPVKLESIASVFKDHAEEGTSEDGTKPDEKSSDQGLQKVGDSDGSSNLDGKKEDEDPQDGGSLASTLSKLKRMKREEGAGATEPEYYHYIPPAHCKVKPNFPFLLFMRASEQMDGDNTTHPKNAPESKKGSSPKPKSCIKAAASQGAEKTVSEVSEQPKETSMTEPSEPGSKAEAKKALGGDVSDQSLESHSQKVSETQMCESNSSKETSLATPAGKESQEGPKHPTGPFFPVLSKDESTALQWPSELLIFTKAEPSISYSCNPLYFDFKLSRNKDARTKGTEKPKDIGSSSKDHLQGLDPGEPNKSKEVGGEKIVRSSGGRMDAPASGSACSGLNKQEPGGSHGSETEDTGRSLPSKKERSGKSHRHKKKKKHKKSSKHKRKHKADTEEKSSKAESGEKSKKRKKRKRKKNKSSAPADSERGPKPEPPGSGSPAPPRRRRRAQDDSQRRSLPAEEGSSGKKDEGGGGSSSQDHGGRKHKGELPPSSCQRRAGTKRSSRSSHRSQPSSGDEDSDDASSHRLHQKSPSQYSEEEEEEDSGSEHSRSRSRSGRRHSSHRSSRRSYSSSSDASSDQSCYSRQRSYSDDSYSDYSDRSRRHSKRSHDSDDSDYASSKHRSKRHKYSSSDDDYSLSCSQSRSRSRSHTRERSRSRGRSRSSSCSRSRSKRRSRSTTAHSWQRSRSYSRDRSRSTRSPSQRSGSRKRSWGHESPEERHSGRRDFIRSKIYRSQSPHYFRSGRGEGPGKKDDGRGDDSKATGPPSQNSNIGTGRGSEGDCSPEDKNSVTAKLLLEKIQSRKVERKPSVSEEVQATPNKAGPKLKDPPQGYFGPKLPPSLGNKPVLPLIGKLPATRKPNKKCEESGLERGEEQEQSETEEGPPGSSDALFGHQFPSEETTGPLLDPPPEESKSGEATADHPVAPLGTPAHSDCYPGDPTISHNYLPDPSDGDTLESLDSSSQPGPVESSLLPIAPDLEHFPSYAPPSGDPSIESTDGAEDASLAPLESQPITFTPEEMEKYSKLQQAAQQHIQQQLLAKQVKAFPASAALAPATPALQPIHIQQPATASATSITTVQHAILQHHAAAAAAAIGIHPHPHPQPLAQVHHIPQPHLTPISLSHLTHSIIPGHPATFLASHPIHIIPASAIHPGPFTFHPVPHAALYPTLLAPRPAAAAATALHLHPLLHPIFSGQDLQHPPSHGT

SEQ ID NO: 33352 - protein, 43 aa, Homo sapiens
  Payload ID: 6547
  Gene Symbol: GPATCH8
  Gene Name: G patch domain containing 8
  Uniprot ID: Q9UKJ3
  ENSP ID: ENSP00000468719
MADRFSRFNEDRDFQGNHFDQYEEGHLEIEQASLDKPIESPSF

SEQ ID NO: 33353 - protein, 46 aa, Homo sapiens; identical to SEQ ID NO: 33348
  Payload ID: 6547
  Gene Symbol: GPATCH8
  Gene Name: G patch domain containing 8
  ENSP ID: ENSP00000468821

SEQ ID NO: 33354 - protein, 491 aa, Homo sapiens
  Payload ID: 6548
  Gene Symbol: GPS1
  Gene Name: G protein pathway suppressor 1
  Uniprot ID: Q13098
  ENSP ID: ENSP00000302873
MPLPVQVFNLQGAVEPMQIDVDPQEDPQNAPDVNYVVENPSLDLEQYAASYSGLMRIERLQFIADHCPTLRVEALKMALSFVQRTFNVDMYEEIHRKLSEATRSSLRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 33355 - protein, 471 aa, Homo sapiens
  Payload ID: 6548
  Gene Symbol: GPS1
  Gene Name: G protein pathway suppressor 1
  ENSP ID: ENSP00000313569
MQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 33356 - protein, 527 aa, Homo sapiens
  Payload ID: 6548
  Gene Symbol: GPS1
  Gene Name: G protein pathway suppressor 1
  Uniprot ID: Q13098
  ENSP ID: ENSP00000376167
MRDSSAPSSASSSVTDLYCTPHSSRSDLVLPGTAGDFSLSASLSACTLLYEGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 33357 - protein, 186 aa, Homo sapiens
  Payload ID: 6548
  Gene Symbol: GPS1
  Gene Name: G protein pathway suppressor 1
  ENSP ID: ENSP00000461965
MPLPVQVFNLQPASSVSGSGGAESQDRMRDSSAPSSASSSVTDLYCTPHSSRSDLVLPGTAGDFSLSASLSACTLLYEGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEP

SEQ ID NO: 33358 - protein, 253 aa, Homo sapiens
  Payload ID: 6548
  Gene Symbol: GPS1
  Gene Name: G protein pathway suppressor 1
  ENSP ID: ENSP00000462029
MPLPVQVFNLQQPASSVSGSGGAESQDRMRDSSAPSSASSSVTDLYCTPHSSRSDLVLPGTAGDFSLSASLSACTLLYEGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRAR

SEQ ID NO: 33359 - protein, 44 aa, Homo sapiens
  Payload ID: 6548
  Gene Symbol: GPS1
  Gene Name: G protein pathway suppressor 1
  ENSP ID: ENSP00000462213
MPLPVQVFNLQSPGRGARCLAHVAGGRGAHADRRGPPGRPAECT

SEQ ID NO: 33360 - protein, 487 aa, Homo sapiens
  Payload ID: 6548
  Gene Symbol: GPS1
  Gene Name: G protein pathway suppressor 1
  Uniprot ID: Q13098
  ENSP ID: ENSP00000462265
MPLPVQVFNLQGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 33361 - protein, 44 aa, Homo sapiens; identical to SEQ ID NO: 33359
  Payload ID: 6548
  Gene Symbol: GPS1
  Gene Name: G protein pathway suppressor 1
  ENSP ID: ENSP00000462297

SEQ ID NO: 33362 - protein, 210 aa, Homo sapiens
  Payload ID: 6548
  Gene Symbol: GPS1
  Gene Name: G protein pathway suppressor 1
  ENSP ID: ENSP00000462391
MQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPE

SEQ ID NO: 33363 - protein, 93 aa, Homo sapiens
  Payload ID: 6548
  Gene Symbol: GPS1
  Gene Name: G protein pathway suppressor 1
  ENSP ID: ENSP00000462705
MPLPVQVFNLQQPASSVSGSGGAESQDRMRDSSAPSSASSSVTDLYCTPHSSRSDLVLPGTAGDFSLSASLSAWGRGAHADRRGPPGRPAECT

SEQ ID NO: 33364 - protein, 139 aa, Homo sapiens
  Payload ID: 6548
  Gene Symbol: GPS1
  Gene Name: G protein pathway suppressor 1
  ENSP ID: ENSP00000462896
MQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKE

SEQ ID NO: 33365 - protein, 168 aa, Homo sapiens
  Payload ID: 6548
  Gene Symbol: GPS1
  Gene Name: G protein pathway suppressor 1
  ENSP ID: ENSP00000463381
MRDSSAPSSASSSVTDLYCTPHSSRSDLVLPGTAGDFSLSASLSACTLLYEGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVE

SEQ ID NO: 33366 - protein, 166 aa, Homo sapiens
  Payload ID: 6548
  Gene Symbol: GPS1
  Gene Name: G protein pathway suppressor 1
  ENSP ID: ENSP00000463514
MRDSSAPSSASSSVTDLYCTPHSSRSDLVLPGTAGDFSLSASLSACTLLYEGAVEPMQIDVDPQEDPQNAPDVNYVVENPSLDLEQYAASYSGLMRIERLQFIADHCPTLRVEALKMALSFVQRTFNVDMYEEIHRKLSEATRSSLRELQNAPDAIPESGVEPPAL

SEQ ID NO: 33367 - protein, 168 aa, Homo sapiens
  Payload ID: 6548
  Gene Symbol: GPS1
  Gene Name: G protein pathway suppressor 1
  ENSP ID: ENSP00000463690
MQIDVDPQEDPQNAPDVNYVVENPSLDLEQYAASYSGLMRIERLQFIADHCPTLRVEALKMALSFVQRTFNVDMYEEIHRKLSEATRSSLRELQNAPDAIPESGVEPPALDTAWVEATRKKALLKLEKLDTDLKNYKGNSIKESIRRGHDDLGDHYLDCGDLSNALKC

SEQ ID NO: 33368 - protein, 60 aa, Homo sapiens
  Payload ID: 6548
  Gene Symbol: GPS1
  Gene Name: G protein pathway suppressor 1
  ENSP ID: ENSP00000463823
MPLPVQVFNLQVPGPCCRGPWSPCRSTWTPRKTRRMHLTSTTWWRTPAWIWNSTRPATAA

SEQ ID NO: 33369 - protein, 79 aa, Homo sapiens
  Payload ID: 6548
  Gene Symbol: GPS1
  Gene Name: G protein pathway suppressor 1
  ENSP ID: ENSP00000463937
QIRNRALIQYFSPYVSADMHRMAAAFNTTVAALEDELTQLILEGLISARVDSHSKSPPREGSQGELTPANSQSRMSTNM

SEQ ID NO: 33370 - protein, 44 aa, Homo sapiens; identical to SEQ ID NO: 33359
  Payload ID: 6548
  Gene Symbol: GPS1
  Gene Name: G protein pathway suppressor 1
  ENSP ID: ENSP00000464530

SEQ ID NO: 33371 - protein, 101 aa, Homo sapiens
  Payload ID: 6548
  Gene Symbol: GPS1
  Gene Name: G protein pathway suppressor 1
  ENSP ID: ENSP00000464571
MQIDVDPQEDPQNAPDVNYVVENPSLDLEQYAASYSGLMRIERLQFIADHCPTLRVEALKMALSFVQRTFNVDMYEEIHRKLSEATRSSLRELQNAPDAIP

SEQ ID NO: 33372 - protein, 134 aa, Homo sapiens
  Payload ID: 6548
  Gene Symbol: GPS1
  Gene Name: G protein pathway suppressor 1
  ENSP ID: ENSP00000464575
MQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKG

SEQ ID NO: 33373 - protein, 526 aa, Homo sapiens
  Payload ID: 6548
  Gene Symbol: GPS1
  Gene Name: G protein pathway suppressor 1
  ENSP ID: ENSP00000485035
MRDSSAPSSASSSVTDLYCTPHSSRSDLVLPGTAGDFSLSASLSACTLLYEGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAERGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 33374 - protein, 486 aa, Homo sapiens
  Payload ID: 6548
  Gene Symbol: GPS1
  Gene Name: G protein pathway suppressor 1
  ENSP ID: ENSP00000485330
MPLPVQVFNLQGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAERGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 33375 - protein, 490 aa, Homo sapiens
  Payload ID: 6548
  Gene Symbol: GPS1
  Gene Name: G protein pathway suppressor 1
  ENSP ID: ENSP00000485641
MPLPVQVFNLQGAVEPMQIDVDPQEDPQNAPDVNYVVENPSLDLEQYAASYSGLMRIERLQFIADHCPTLRVEALKMALSFVQRTFNVDMYEEIHRKLSEATRSSLRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAERGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 33376 - protein, 327 aa, Homo sapiens
  Payload ID: 6549
  Gene Symbol: GPS2
  Gene Name: G protein pathway suppressor 2
  Uniprot ID: Q13227
  ENSP ID: ENSP00000370104
MPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 33377 - protein, 327 aa, Homo sapiens; identical to SEQ ID NO: 33376
  Payload ID: 6549
  Gene Symbol: GPS2
  Gene Name: G protein pathway suppressor 2
  Uniprot ID: Q13227
  ENSP ID: ENSP00000379841

SEQ ID NO: 33378 - protein, 158 aa, Homo sapiens
  Payload ID: 6549
  Gene Symbol: GPS2
  Gene Name: G protein pathway suppressor 2
  ENSP ID: ENSP00000458837
TRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSALHPAPGLLASPQLPVQMQPAGKSGFAATSQPGPRLPFIQHSQNPRFYHK

SEQ ID NO: 33379 - protein, 73 aa, Homo sapiens
  Payload ID: 6549
  Gene Symbol: GPS2
  Gene Name: G protein pathway suppressor 2
  ENSP ID: ENSP00000459357
  MOD_RES (1)..(1): Any amino acid
XLSLQKQMEHANQQTGFSDSSSLRPMHPQALHPAPGLLASPQLPVQMQPAGKVRMVIEFTCQNPYTRDPEKQD

SEQ ID NO: 33380 - protein, 327 aa, Homo sapiens
  Payload ID: 6549
  Gene Symbol: GPS2
  Gene Name: G protein pathway suppressor 2
  ENSP ID: ENSP00000460836
  MOD_RES (1)..(1): Any amino acid
XRPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKTAP

SEQ ID NO: 33381 - protein, 259 aa, Homo sapiens
  Payload ID: 6549
  Gene Symbol: GPS2
  Gene Name: G protein pathway suppressor 2
  ENSP ID: ENSP00000461624
MPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHA

SEQ ID NO: 33382 - protein, 1008 aa, Homo sapiens
  Payload ID: 6550
  Gene Symbol: GPRIN1
  Gene Name: G protein regulated inducer of neurite outgrowth 1
  Uniprot ID: Q7Z2K8
  ENSP ID: ENSP00000305839
MDTAEDPAWLQLLQKDSSPPGPRPTAFFCPQDGSLGAGSSAMRDYCPSQQKASPAPPRHTPDQSPGMESRHRSPSGAGEGASCSDGPRGSLACPSPTCFSPQESPSKETLEAHGASISGTPEATTSGKPEPVSSVKTEPKSSDDRNPMFLEKMDFKSSKQADSTSIGKEDPGSSRKADPMFTGKAEPEILGKGDPVAPGRMDPMTVRKEDLGSLGKVDPLCSSKTYTVSPRKEDPGSLRKVDPVSSDKVDPVFPRKEEPRYSGKEHPVSSEKVAPTSAEKVDLVLSGKRDPGPSGKADPMPLESMDSASTGKTEPGLLGKLIPGSSGKNGPVSSGTGAPGSLGRLDPTCLGMADPASVGNVETVPATKEDSRFLGKMDPASSGEGRPVSGHTDTTASAKTDLTSLKNVDPMSSGKVDPVSLGKMDPMCSGKPELLSPGQAERVSVGKAGTVSPGKEDPVSSRREDPISAGSRKTSSEKVNPESSGKTNPVSSGPGDPRSLGTAGPPSAVKAEPATGGKGDPLSSEKAGLVASGKAAPTASGKAEPLAVGKEDPVSKGKADAGPSGQGDSVSIGKVVSTPGKTVPVPSGKVDPVSLGKAEAIPEGKVGSLPLEKGSPVTTTKADPRASGKAQPQSGGKAETKLPGQEGAAAPGEAGAVCLKKETPQASEKVDPGSCRKAEPLASGKGEPVSLGKADSAPSRKTESPSLGKVVPLSLEKTKPSSSSRQLDRKALGSARSPEGARGSEGRVEPKAEPVSSTEASSLGQKDLEAAGAERSPCPEAAAPPPGPRTRDNFTKAPSWEASAPPPPREDAGTQAGAQACVSVAVSPMSPQDGAGGSAFSFQAAPRAPSPPSRRDAGLQVSLGAAETRSVATGPMTPQAAAPPAFPEVRVRPGSALAAAVAPPEPAEPVRDVSWDEKGMTWEVYGAAMEVEVLGMAIQKHLERQIEEHGRQGAPAPPPAARAGPGRSGSVRTAPPDGAAKRPPGLFRALLQSVRRPRCCSRAGPTAE

SEQ ID NO: 33383 - protein, 458 aa, Homo sapiens
  Payload ID: 6551
  Gene Symbol: GPRIN2
  Gene Name: G protein regulated inducer of neurite outgrowth 2
  Uniprot ID: O60269
  ENSP ID: ENSP00000363433
MSSSRPEPGPWAPLSPRLQPLSQSSSSLLGEGREQRPELRKTASSTVWQAQLGEASTRPQAPEEEGNPPESMKPARASGPKARPSAGGHWWSSTVGNVSTMGGSDLCRLRAPSAAAMQRSHSDLVRSTQMRGHSGARKASLSCSALGSSPVHRAQLQPGGTSGQGGQAPAGLERDLAPEDETSNSAWMLGASQLSVPPLDLGDTTAHSSSAQAEPKAAEQLATTTCHALPPAALLCGMREVRAGGCCHALPATGILAFPKLVASVSESGLQAQHGVKIHCRLSGGLPGHSHCCAHLWGPAGLVPEPGSRTKDVWTMTSANDLAPAEASPLSAQDAGVQAAPVAACKAVATSPSLEAPAALHVFPEVTLGSSLEEVPSPVRDVRWDAEGMTWEVYGAAVDLEVLGVAIQKHLEMQFEQLQRAPASEDSLSVEGRRGPLRAVMQSLRRPSCCGCSGAAPE

SEQ ID NO: 33384 - protein, 458 aa, Homo sapiens; identical to SEQ ID NO: 33383
  Payload ID: 6551
  Gene Symbol: GPRIN2
  Gene Name: G protein regulated inducer of neurite outgrowth 2
  Uniprot ID: O60269
  ENSP ID: ENSP00000363436

SEQ ID NO: 33385 - protein, 330 aa, Homo sapiens
  Payload ID: 6552
  Gene Symbol: GPBAR1
  Gene Name: G protein-coupled bile acid receptor 1
  Uniprot ID: Q8TDU6
  ENSP ID: ENSP00000428824
MTPNSTGEVPSPIPKGALGLSLALASLIITANLLLALGIAWDRRLRSPPAGCFFLSLLLAGLLTGLALPTLPGLWNQSRRGYWSCLLVYLAPNFSFLSLLANLLLVHGERYMAVLRPLQPPGSIRLALLLTWAGPLLFASLPALGWNHWTPGANCSSQAIFPAPYLYLEVYGLLLPAVGAAAFLSVRVLATAHRQLQDICRLERAVCRDEPSALARALTWRQARAQAGAMLLFGLCWGPYVATLLLSVLAYEQRPPLGPGTLLSLLSLGSASAAAVPVAMGLGDQRYTAPWRAAAQRCLQGLWGRASRDSPGPSIAYHPSSQSSVDLDLN

SEQ ID NO: 33386 - protein, 330 aa, Homo sapiens; identical to SEQ ID NO: 33385
  Payload ID: 6552
  Gene Symbol: GPBAR1
  Gene Name: G protein-coupled bile acid receptor 1
  Uniprot ID: Q8TDU6
  ENSP ID: ENSP00000430202

SEQ ID NO: 33387 - protein, 330 aa, Homo sapiens; identical to SEQ ID NO: 33385
  Payload ID: 6552
  Gene Symbol: GPBAR1
  Gene Name: G protein-coupled bile acid receptor 1
  Uniprot ID: Q8TDU6
  ENSP ID: ENSP00000430698

SEQ ID NO: 33388 - protein, 330 aa, Homo sapiens; identical to SEQ ID NO: 33385
  Payload ID: 6552
  Gene Symbol: GPBAR1
  Gene Name: G protein-coupled bile acid receptor 1
  Uniprot ID: Q8TDU6
  ENSP ID: ENSP00000430886

SEQ ID NO: 33389 - protein, 375 aa, Homo sapiens
  Payload ID: 6553
  Gene Symbol: GPER1
  Gene Name: G protein-coupled estrogen receptor 1
  Uniprot ID: Q99527
  ENSP ID: ENSP00000297469
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 33390 - protein, 375 aa, Homo sapiens; identical to SEQ ID NO: 33389
  Payload ID: 6553
  Gene Symbol: GPER1
  Gene Name: G protein-coupled estrogen receptor 1
  Uniprot ID: Q99527
  ENSP ID: ENSP00000380277

SEQ ID NO: 33391 - protein, 375 aa, Homo sapiens; identical to SEQ ID NO: 33389
  Payload ID: 6553
  Gene Symbol: GPER1
  Gene Name: G protein-coupled estrogen receptor 1
  Uniprot ID: Q99527
  ENSP ID: ENSP00000380281

SEQ ID NO: 33392 - protein, 375 aa, Homo sapiens; identical to SEQ ID NO: 33389
  Payload ID: 6553
  Gene Symbol: GPER1
  Gene Name: G protein-coupled estrogen receptor 1
  Uniprot ID: Q99527
  ENSP ID: ENSP00000385151

SEQ ID NO: 33393 - protein, 73 aa, Homo sapiens
  Payload ID: 6553
  Gene Symbol: GPER1
  Gene Name: G protein-coupled estrogen receptor 1
  ENSP ID: ENSP00000410487
MDVTSQARGVGLEMYPGTAQPAAPNTTSPELNLSHPLLGTALANGTGELSEHQQYVIGLFLSCLYTIFLFPIG

SEQ ID NO: 33394 - protein, 408 aa, Homo sapiens
  Payload ID: 6553
  Gene Symbol: GPER1
  Gene Name: G protein-coupled estrogen receptor 1
  ENSP ID: ENSP00000479553
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTHGHVMSLNCGQMWLLAPRGLARVTLAWSPWGCLGNLTTGHLALLTQNCYNPKALAPQGPKASGDQPVTQLLPANPACRCTCLPLQETFLTPSTRKATRRGHCG

SEQ ID NO: 33395 - protein, 176 aa, Homo sapiens
  Payload ID: 6553
  Gene Symbol: GPER1
  Gene Name: G protein-coupled estrogen receptor 1
  ENSP ID: ENSP00000483756
MSLNCGQMWLLAPRGLARVTLAWSPWGCLGNLTTGHLALLTQNCYNPKALAPQGPKASGDQPVTQLLPANPACRCTCLPLQETFLSVLHLPGWQQWRCAASPGPRGAAALGPEQQEGPSVERPPSAPGWFSHCLLTSTWQLHSCGLGPCELPCGLVGCQDNEILQHLWLTNLFLQK

SEQ ID NO: 33396 - protein, 355 aa, Homo sapiens
  Payload ID: 6554
  Gene Symbol: GPR1
  Gene Name: G protein-coupled receptor 1
  Uniprot ID: P46091
  ENSP ID: ENSP00000384345
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDTVEFNNHTLCYNNFQKHDPDLTLIRHHVLTWVKFIIGYLFPLLTMSICYLCLIFKVKKRSILISSRHFWTILVVVVAFVVCWTPYHLFSIWELTIHHNSYSHHVMQAGIPLSTGLAFLNSCLNPILYVLISKKFQARFRSSVAEILKYTLWEVSCSGTVSEQLRNSETKNLCLLETAQ

SEQ ID NO: 33397 - protein, 178 aa, Homo sapiens
  Payload ID: 6554
  Gene Symbol: GPR1
  Gene Name: G protein-coupled receptor 1
  ENSP ID: ENSP00000391146
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDT

SEQ ID NO: 33398 - protein, 355 aa, Homo sapiens; identical to SEQ ID NO: 33396
  Payload ID: 6554
  Gene Symbol: GPR1
  Gene Name: G protein-coupled receptor 1
  Uniprot ID: P46091
  ENSP ID: ENSP00000397535

SEQ ID NO: 33399 - protein, 73 aa, Homo sapiens
  Payload ID: 6554
  Gene Symbol: GPR1
  Gene Name: G protein-coupled receptor 1
  ENSP ID: ENSP00000404861
MEDLEETLFEEFENYSYDLDYYSLESDLEEKVQLGVVHWVSLVLYCLAFVLGIPGNAIVIWFTGFKWKKTVTT

SEQ ID NO: 33400 - protein, 82 aa, Homo sapiens
  Payload ID: 6554
  Gene Symbol: GPR1
  Gene Name: G protein-coupled receptor 1
  ENSP ID: ENSP00000409577
MEDLEETLFEEFENYSYDLDYYSLESDLEEKVQLGVVHWVSLVLYCLAFVLGIPGNAIVIWFTGFKWKKTVTTLWFLNLAIA

SEQ ID NO: 33401 - protein, 137 aa, Homo sapiens
  Payload ID: 6554
  Gene Symbol: GPR1
  Gene Name: G protein-coupled receptor 1
  ENSP ID: ENSP00000414524
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYI

SEQ ID NO: 33402 - protein, 227 aa, Homo sapiens
  Payload ID: 6554
  Gene Symbol: GPR1
  Gene Name: G protein-coupled receptor 1
  ENSP ID: ENSP00000414836
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDTVEFNNHTLCYNNFQKHDPDLTLIRHHVLTWVKFIIGYLFPLLTMSICYL

SEQ ID NO: 33403 - protein, 19 aa, Homo sapiens
  Payload ID: 6554
  Gene Symbol: GPR1
  Gene Name: G protein-coupled receptor 1
  ENSP ID: ENSP00000416474
MEDLEETLFEEFENYSYDL

SEQ ID NO: 33404 - protein, 355 aa, Homo sapiens; identical to SEQ ID NO: 33396
  Payload ID: 6554
  Gene Symbol: GPR1
  Gene Name: G protein-coupled receptor 1
  Uniprot ID: P46091
  ENSP ID: ENSP00000480405

SEQ ID NO: 33405 - protein, 355 aa, Homo sapiens; identical to SEQ ID NO: 33396
  Payload ID: 6554
  Gene Symbol: GPR1
  Gene Name: G protein-coupled receptor 1
  Uniprot ID: P46091
  ENSP ID: ENSP00000483003

SEQ ID NO: 33406 - protein, 508 aa, Homo sapiens
  Payload ID: 6555
  Gene Symbol: GPR101
  Gene Name: G protein-coupled receptor 101
  Uniprot ID: Q96P66
  ENSP ID: ENSP00000298110
MTSTCTNSTRESNSSHTCMPLSKMPISLAHGIIRSTVLVIFLAASFVGNIVLALVLQRKPQLLQVTNRFIFNLLVTDLLQISLVAPWVVATSVPLFWPLNSHFCTALVSLTHLFAFASVNTIVVVSVDRYLSIIHPLSYPSKMTQRRGYLLLYGTWIVAILQSTPPLYGWGQAAFDERNALCSMIWGASPSYTILSVVSFIVIPLIVMIACYSVVFCAARRQHALLYNVKRHSLEVRVKDCVENEDEEGAEKKEEFQDESEFRRQHEGEVKAKEGRMEAKDGSLKAKEGSTGTSESSVEARGSEEVRESSTVASDGSMEGKEGSTKVEENSMKADKGRTEVNQCSIDLGEDDMEFGEDDINFSEDDVEAVNIPESLPPSRRNSNSNPPLPRCYQCKAAKVIFIIIFSYVLSLGPYCFLAVLAVWVDVETQVPQWVITIIIWLFFLQCCIHPYVYGYMHKTIKKEIQDMLKKFFCKEKPPKEDSHPDLPGTEGGTEGKIVPSYDSATFP

SEQ ID NO: 33407 - protein, 552 aa, Homo sapiens
  Payload ID: 6556
  Gene Symbol: GPR107
  Gene Name: G protein-coupled receptor 107
  Uniprot ID: Q5VW38
  ENSP ID: ENSP00000336988
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 33408 - protein, 600 aa, Homo sapiens
  Payload ID: 6556
  Gene Symbol: GPR107
  Gene Name: G protein-coupled receptor 107
  Uniprot ID: Q5VW38
  ENSP ID: ENSP00000361483
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIESHHFAQADLELLASSCPPASVSQRAGITAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 33409 - protein, 571 aa, Homo sapiens
  Payload ID: 6556
  Gene Symbol: GPR107
  Gene Name: G protein-coupled receptor 107
  ENSP ID: ENSP00000361487
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 33410 - protein, 128 aa, Homo sapiens
  Payload ID: 6556
  Gene Symbol: GPR107
  Gene Name: G protein-coupled receptor 107
  ENSP ID: ENSP00000475772
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRR

SEQ ID NO: 33411 - protein, 600 aa, Homo sapiens; identical to SEQ ID NO: 33408
  Payload ID: 6556
  Gene Symbol: GPR107
  Gene Name: G protein-coupled receptor 107
  Uniprot ID: Q5VW38
  ENSP ID: ENSP00000483750

SEQ ID NO: 33412 - protein, 543 aa, Homo sapiens
  Payload ID: 6557
  Gene Symbol: GPR108
  Gene Name: G protein-coupled receptor 108
  Uniprot ID: Q9NPR9
  ENSP ID: ENSP00000264080
MAVSERRGLGRGSPAEWGQRLLLVLLLGGCSGRIHQLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 33413 - protein, 301 aa, Homo sapiens
  Payload ID: 6557
  Gene Symbol: GPR108
  Gene Name: G protein-coupled receptor 108
  ENSP ID: ENSP00000401284
MIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 33414 - protein, 224 aa, Homo sapiens
  Payload ID: 6557
  Gene Symbol: GPR108
  Gene Name: G protein-coupled receptor 108
  ENSP ID: ENSP00000469797
  MOD_RES (1)..(1): Any amino acid
XAVSERRGLGRGSPAEWGQRLLLVLLLGGCSGRIHQLALTGEKRADIQLNSFGFYTNGSLEVELSVLRLGLREAEEKSLLTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDIT

SEQ ID NO: 33415 - protein, 36 aa, Homo sapiens
  Payload ID: 6557
  Gene Symbol: GPR108
  Gene Name: G protein-coupled receptor 108
  ENSP ID: ENSP00000470197
MIREKNPDGFLSAAEMPLFKLYMVMSACFLAAGIFW

SEQ ID NO: 33416 - protein, 177 aa, Homo sapiens
  Payload ID: 6557
  Gene Symbol: GPR108
  Gene Name: G protein-coupled receptor 108
  ENSP ID: ENSP00000470823
SGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVAVPFQWQWLYQLLVEGSTLAFFVLTGYKFQPTGNNPYLQLPQEDEEDVQMEQVMTDSGFREGLSKVNKTASGRELL

SEQ ID NO: 33417 - protein, 103 aa, Homo sapiens
  Payload ID: 6557
  Gene Symbol: GPR108
  Gene Name: G protein-coupled receptor 108
  ENSP ID: ENSP00000470844
  MOD_RES (1)..(1): Any amino acid
XVLLLGGCSGRIHQLALTGEKRADIQLNSFGFYTNGSLEVELSVLRLGLREAEEKSLLVGFSLSRVRSGRVRSYSTRDFQDCPLQKNSSSFLVLFLINTKDLQ

SEQ ID NO: 33418 - protein, 331 aa, Homo sapiens
  Payload ID: 6557
  Gene Symbol: GPR108
  Gene Name: G protein-coupled receptor 108
  ENSP ID: ENSP00000471846
  MOD_RES (1)..(1): Any amino acid
XRGLGRGSPAEWGQRLLLVLLLGGCSGRIHQLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHL

SEQ ID NO: 33419 - protein, 145 aa, Homo sapiens
  Payload ID: 6557
  Gene Symbol: GPR108
  Gene Name: G protein-coupled receptor 108
  ENSP ID: ENSP00000472048
  MOD_RES (1)..(1): Any amino acid
XPAEWGQRLLLVLLLGGCSGRIHQLALTGEKRADIQLNSFGFYTNGSLEVELSVLRLGLREAEEKSLLVGFSLSRVRSGRVRSYSGPGAEVWRAEDVVYLSRAPPGSTLQTRAPEATGHSPPQGGWRRDLCSQQAQVNTRSDSGS

SEQ ID NO: 33420 - protein, 167 aa, Homo sapiens
  Payload ID: 6557
  Gene Symbol: GPR108
  Gene Name: G protein-coupled receptor 108
  ENSP ID: ENSP00000472496
CCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVVCGEVEGVHVDQAPSSPGPRFPDKPIWKKSPFLPPNIGQPCPYPGTTPPFQLCVQ

SEQ ID NO: 33421 - protein, 194 aa, Homo sapiens
  Payload ID: 6557
  Gene Symbol: GPR108
  Gene Name: G protein-coupled receptor 108
  ENSP ID: ENSP00000473228
  MOD_RES (1)..(1): Any amino acid
XDDPGEEPRWLPVGSGDAPFQALHGHVRLLPGRWHLLGVHPLQEHINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRI

SEQ ID NO: 33422 - protein, 335 aa, Homo sapiens
  Payload ID: 6558
  Gene Symbol: GPR119
  Gene Name: G protein-coupled receptor 119
  Uniprot ID: Q8TDV5
  ENSP ID: ENSP00000276218
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 33423 - protein, 334 aa, Homo sapiens
  Payload ID: 6559
  Gene Symbol: GPR12
  Gene Name: G protein-coupled receptor 12
  Uniprot ID: P47775
  ENSP ID: ENSP00000370844
MNEDLKVNLSGLPRDYLDAAAAENISAAVSSRVPAVEPEPELVVNPWDIVLCTSGTLISCENAIVVLIIFHNPSLRAPMFLLIGSLALADLLAGIGLITNFVFAYLLQSEATKLVTIGLIVASFSASVCSLLAITVDRYLSLYYALTYHSERTVTFTYVMLVMLWGTSICLGLLPVMGWNCLRDESTCSVVRPLTKNNAAILSVSFLFMFALMLQLYIQICKIVMRHAHQIALQHHFLATSHYVTTRKGVSTLAIILGTFAACWMPFTLYSLIADYTYPSIYTYATLLPATYNSIINPVIYAFRNQEIQKALCLICCGCIPSSLAQRARSPSDV

SEQ ID NO: 33424 - protein, 334 aa, Homo sapiens; identical to SEQ ID NO: 33423
  Payload ID: 6559
  Gene Symbol: GPR12
  Gene Name: G protein-coupled receptor 12
  Uniprot ID: P47775
  ENSP ID: ENSP00000384932

SEQ ID NO: 33425 - protein, 380 aa, Homo sapiens
  Payload ID: 6560
  Gene Symbol: GPR132
  Gene Name: G protein-coupled receptor 132
  Uniprot ID: Q9UNW8
  ENSP ID: ENSP00000328818
MCPMLLKNGYNGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 33426 - protein, 371 aa, Homo sapiens
  Payload ID: 6560
  Gene Symbol: GPR132
  Gene Name: G protein-coupled receptor 132
  Uniprot ID: Q9UNW8
  ENSP ID: ENSP00000376364
MPGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 33427 - protein, 380 aa, Homo sapiens; identical to SEQ ID NO: 33425
  Payload ID: 6560
  Gene Symbol: GPR132
  Gene Name: G protein-coupled receptor 132
  Uniprot ID: Q9UNW8
  ENSP ID: ENSP00000438094

SEQ ID NO: 33428 - protein, 68 aa, Homo sapiens
  Payload ID: 6560
  Gene Symbol: GPR132
  Gene Name: G protein-coupled receptor 132
  ENSP ID: ENSP00000448513
MCPMLLKNGYNGAEARSVCGFLLTWRWDSMICNHRRPRSMNSARVGSQDTGAGGAGRAWGSHTTAHPA

SEQ ID NO: 33429 - protein, 10 aa, Homo sapiens
  Payload ID: 6560
  Gene Symbol: GPR132
  Gene Name: G protein-coupled receptor 132
  ENSP ID: ENSP00000448776
MCPMLLKNGY

SEQ ID NO: 33430 - protein, 494 aa, Homo sapiens
  Payload ID: 6561
  Gene Symbol: GPR135
  Gene Name: G protein-coupled receptor 135
  Uniprot ID: Q8IZ08
  ENSP ID: ENSP00000378548
MEEPQPPRPPASMALLGSQHSGAPSAAGPPGGTSSAATAAVLSFSTVATAALGNLSDASGGGTAAAPGGGGLGGSGAAREAGAAVRRPLGPEAAPLLSHGAAVAAQALVLLLIFLLSSLGNCAVMGVIVKHRQLRTVTNAFILSLSLSDLLTALLCLPAAFLDLFTPPGGSAPAAAAGPWRGFCAASRFFSSCFGIVSTLSVALISLDRYCAIVRPPREKIGRRRALQLLAGAWLTALGFSLPWELLGAPRELAAAQSFHGCLYRTSPDPAQLGAAFSVGLVVACYLLPFLLMCFCHYHICKTVRLSDVRVRPVNTYARVLRFFSEVRTATTVLIMIVFVICCWGPYCFLVLLAAARQAQTMQAPSLLSVVAVWLTWANGAINPVIYAIRNPNISMLLGRNREEGYRTRNVDAFLPSQGPGLQARSRSRLRNRYANRLGACNRMSSSNPASGVAGDVAMWARKNPVVLFCREGPPEPVTAVTKQPKSEAGDTSL

SEQ ID NO: 33431 - protein, 494 aa, Homo sapiens; identical to SEQ ID NO: 33430
  Payload ID: 6561
  Gene Symbol: GPR135
  Gene Name: G protein-coupled receptor 135
  Uniprot ID: Q8IZ08
  ENSP ID: ENSP00000432696

SEQ ID NO: 33432 - protein, 417 aa, Homo sapiens
  Payload ID: 6562
  Gene Symbol: GPR137
  Gene Name: G protein-coupled receptor 137
  Uniprot ID: Q96N19
  ENSP ID: ENSP00000321698
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLSTSHILNGQVFASRSYFFDRAGHCEDEGCSWEHSRGESTRCQDQAATTTVSTPPHRRDPPPSPTEYPGPSPPHPRPLCQVCLPLLAQDPGGRGYPLLWPAPCCSCHSELVPSP

SEQ ID NO: 33433 - protein, 346 aa, Homo sapiens
  Payload ID: 6562
  Gene Symbol: GPR137
  Gene Name: G protein-coupled receptor 137
  Uniprot ID: Q96N19
  ENSP ID: ENSP00000366931
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKADLVNDLGNKGYLVFGLILFVWELLPTTLLVGFFRVHRPPQDLSTSHILNGQVFASRSYFFDRAGHCEDEGCSWEHSRGESTSMSGSLGSGSWYGAIGREPGWYGGSQTKTTPLLFSQVPGPGGHHHSLYSTPQT

SEQ ID NO: 33434 - protein, 475 aa, Homo sapiens
  Payload ID: 6562
  Gene Symbol: GPR137
  Gene Name: G protein-coupled receptor 137
  Uniprot ID: Q96N19
  ENSP ID: ENSP00000411827
MLWAVRTRCYVVKAQLGPTVALEGRAPRAPGPSCLGNGNCQRPGPITSRNVTRASLPDMESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLSTSHILNGQVFASRSYFFDRAGHCEDEGCSWEHSRGESTRCQDQAATTTVSTPPHRRDPPPSPTEYPGPSPPHPRPLCQVCLPLLAQDPGGRGYPLLWPAPCCSCHSELVPSP

SEQ ID NO: 33435 - protein, 396 aa, Homo sapiens
  Payload ID: 6562
  Gene Symbol: GPR137
  Gene Name: G protein-coupled receptor 137
  Uniprot ID: Q96N19
  ENSP ID: ENSP00000415698
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLSTSHILNGQVFASRSYFFDRAGHCEDEGCSWEHSRGESTSMSGSLGSGSWYGAIGREPGWYGGSQTKTTPLLFSQVPGPGGHHHSLYSTPQT

SEQ ID NO: 33436 - protein, 139 aa, Homo sapiens
  Payload ID: 6562
  Gene Symbol: GPR137
  Gene Name: G protein-coupled receptor 137
  ENSP ID: ENSP00000438146
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLRTW

SEQ ID NO: 33437 - protein, 219 aa, Homo sapiens
  Payload ID: 6562
  Gene Symbol: GPR137
  Gene Name: G protein-coupled receptor 137
  ENSP ID: ENSP00000438716
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAA

SEQ ID NO: 33438 - protein, 31 aa, Homo sapiens
  Payload ID: 6562
  Gene Symbol: GPR137
  Gene Name: G protein-coupled receptor 137
  ENSP ID: ENSP00000440928
MNLYFAQVVFKAKVKRRPEMSRGLLAVRGAF

SEQ ID NO: 33439 - protein, 240 aa, Homo sapiens
  Payload ID: 6562
  Gene Symbol: GPR137
  Gene Name: G protein-coupled receptor 137
  ENSP ID: ENSP00000441003
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTAL

SEQ ID NO: 33440 - protein, 139 aa, Homo sapiens
  Payload ID: 6562
  Gene Symbol: GPR137
  Gene Name: G protein-coupled receptor 137
  ENSP ID: ENSP00000441034
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGFGSQ

SEQ ID NO: 33441 - protein, 63 aa, Homo sapiens
  Payload ID: 6562
  Gene Symbol: GPR137
  Gene Name: G protein-coupled receptor 137
  ENSP ID: ENSP00000442322
MESNLSGLVPAAGLVPALPPAVTLGLTAAYTTLYALLFFSVYAQLWLVLLYGHKRLSYQTVFL

SEQ ID NO: 33442 - protein, 320 aa, Homo sapiens
  Payload ID: 6562
  Gene Symbol: GPR137
  Gene Name: G protein-coupled receptor 137
  Uniprot ID: Q96N19
  ENSP ID: ENSP00000442792
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLYVGQSRLWELVWCHRA

SEQ ID NO: 33443 - protein, 156 aa, Homo sapiens
  Payload ID: 6562
  Gene Symbol: GPR137
  Gene Name: G protein-coupled receptor 137
  ENSP ID: ENSP00000442929
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLRAPSTSIYLEAKGTSVCQAA

SEQ ID NO: 33444 - protein, 88 aa, Homo sapiens
  Payload ID: 6562
  Gene Symbol: GPR137
  Gene Name: G protein-coupled receptor 137
  ENSP ID: ENSP00000443443
  MOD_RES (1)..(1): Any amino acid
XTKATWYLASSSSCGSYCPPPCWWASSGCTGPHRTCMSGSLGSGSWYGAIGREPGWYGGSQTKTTPLLFSQVPGPGGHHHSLYSTPQT

SEQ ID NO: 33445 - protein, 167 aa, Homo sapiens
  Payload ID: 6562
  Gene Symbol: GPR137
  Gene Name: G protein-coupled receptor 137
  ENSP ID: ENSP00000445000
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQ

SEQ ID NO: 33446 - protein, 225 aa, Homo sapiens
  Payload ID: 6562
  Gene Symbol: GPR137
  Gene Name: G protein-coupled receptor 137
  ENSP ID: ENSP00000445570
MASLPDMESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAA

SEQ ID NO: 33447 - protein, 132 aa, Homo sapiens
  Payload ID: 6562
  Gene Symbol: GPR137
  Gene Name: G protein-coupled receptor 137
  ENSP ID: ENSP00000446342
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEM

SEQ ID NO: 33448 - protein, 78 aa, Homo sapiens
  Payload ID: 6562
  Gene Symbol: GPR137
  Gene Name: G protein-coupled receptor 137
  ENSP ID: ENSP00000446387
MESNLSGLVPAAGLVPALPPAVTLGLTAAYTTLYALLFFSVYAQLWLVLLYGHKRLSYQTVFLALCLLWAALRTTLFS

SEQ ID NO: 33449 - protein, 211 aa, Homo sapiens
  Payload ID: 6562
  Gene Symbol: GPR137
  Gene Name: G protein-coupled receptor 137
  ENSP ID: ENSP00000484728
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVAGGRPPLASTWRPR

SEQ ID NO: 33450 - protein, 399 aa, Homo sapiens
  Payload ID: 6563
  Gene Symbol: GPR137B
  Gene Name: G protein-coupled receptor 137B
  Uniprot ID: O60478
  ENSP ID: ENSP00000355551
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGFAPDYYDWGQQTNSFLAQAGTLQDSTLDPDKPSLG

SEQ ID NO: 33451 - protein, 230 aa, Homo sapiens
  Payload ID: 6563
  Gene Symbol: GPR137B
  Gene Name: G protein-coupled receptor 137B
  ENSP ID: ENSP00000395814
  MOD_RES (1)..(1): Any amino acid
XQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGLL

SEQ ID NO: 33452 - protein, 180 aa, Homo sapiens
  Payload ID: 6563
  Gene Symbol: GPR137B
  Gene Name: G protein-coupled receptor 137B
  ENSP ID: ENSP00000401841
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVAPLPGLPLHQPCFPVGEFNLCCAGKDGKLGEEGYRLCASGH

SEQ ID NO: 33453 - protein, 429 aa, Homo sapiens
  Payload ID: 6564
  Gene Symbol: GPR137C
  Gene Name: G protein-coupled receptor 137C
  Uniprot ID: Q8N3F9
  ENSP ID: ENSP00000315106
MRVSVPGPAAAAAPAAGREPSTPGGGSGGGGAVAAASGAAVPGSVQLALSVLHALLYAALFAFAYLQLWRLLLYRERRLSYQSLCLFLCLLWAALRTTLFSAAFSLSGSLPLLRPPAHLHFFPHWLLYCFPSCLQFSTLCLLNLYLAEVICKVRCATELDRHKILLHLGFIMASLLFLVVNLTCAMLVHGDVPENQLKWTVFVRALINDSLFILCAISLVCYICKITKMSSANVYLESKGMSLCQTVVVGSVVILLYSSRACYNLVVVTISQDTLESPFNYGWDNLSDKAHVEDISGEEYIVFGMVLFLWEHVPAWSVVLFFRAQRLNQNLAPAGMINSHSYSSRAYFFDNPRRYDSDDDLPRLGSSREGSLPNSQSLGWYGTMTGCGSSSYTVTPHLNGPMTDTAPLLFTCSNLDLNNHHSLYVTPQN

SEQ ID NO: 33454 - protein, 399 aa, Homo sapiens
  Payload ID: 6564
  Gene Symbol: GPR137C
  Gene Name: G protein-coupled receptor 137C
  ENSP ID: ENSP00000439165
  MOD_RES (1)..(1): Any amino acid
XALSVLHALLYAALFAFAYLQLWRLLLYRERRLSYQSLCLFLCLLWAALRTTLFSAAFSLSGSLPLLRPPAHLHFFPHWLLYCFPSCLQFSTLCLLNLYLAEVICKVRCATELDRHKILLHLGFIMASLLFLVVNLTCAMLVHGDVPENQLKWTVFVRALINDSLFILCAISLVCYICKITKMSSANVYLESKITGSHSFLWLNSTPLCGMSLCQTVVVGSVVILLYSSRACYNLVVVTISQDTLESPFNYGWDNLSDKAHVEDISGEEYIVFGMVLFLWEHVPAWSVVLFFRAQRLNQNLAPAGMINSHSYSSRAYFFDNPRRYDSDDDLPRLGSSREGSLPNSQSLGWYGTMTGCGSSSYTVTPHLNGPMTDTAPLLFTCSNLDLNNHHSLYVTPQN

SEQ ID NO: 33455 - protein, 204 aa, Homo sapiens
  Payload ID: 6564
  Gene Symbol: GPR137C
  Gene Name: G protein-coupled receptor 137C
  ENSP ID: ENSP00000452563
  MOD_RES (1)..(1): Any amino acid
XWAALRTTLFSAAFSLSGSLPLLRPPAHLHFFPHWLLYCFPSCLQFSTLCLLNLYLAEVLQTGAVPIWPSWKEPILYLQMVICKVRCATELDRHKILLHLGFIMASLLFLVVNLTCAMLVHGDVPENQLKWTVFVRALINDSLFILCAISLVCYICKITKMSSANVYLESKGMSLCQTVVVGSVVILLYSSRACYNLVVVTISQ

SEQ ID NO: 33456 - protein, 50 aa, Homo sapiens
  Payload ID: 6565
  Gene Symbol: GPR139
  Gene Name: G protein-coupled receptor 139
  ENSP ID: ENSP00000370779
MEHTHAHLAANSSLSWWSPGSACGLGFVPVVYYSLLLCLGLPDIMKPIKL

SEQ ID NO: 33457 - protein, 353 aa, Homo sapiens
  Payload ID: 6565
  Gene Symbol: GPR139
  Gene Name: G protein-coupled receptor 139
  Uniprot ID: Q6DWJ6
  ENSP ID: ENSP00000458791
MEHTHAHLAANSSLSWWSPGSACGLGFVPVVYYSLLLCLGLPANILTVIILSQLVARRQKSSYNYLLALAAADILVLFFIVFVDFLLEDFILNMQMPQVPDKIIEVLEFSSIHTSIWITVPLTIDRYIAVCHPLKYHTVSYPARTRKVIVSVYITCFLTSIPYYWWPNIWTEDYISTSVHHVLIWIHCFTVYLVPCSIFFILNSIIVYKLRRKSNFRLRGYSTGKTTAILFTITSIFATLWAPRIIMILYHLYGAPIQNRWLVHIMSDIANMLALLNTAINFFLYCFISKRFRTMAAATLKAFFKCQKQPVQFYTNHNFSITSSPWISPANSHCIKMLVYQYDKNGKPIKVSP

SEQ ID NO: 33458 - protein, 305 aa, Homo sapiens
  Payload ID: 6566
  Gene Symbol: GPR141
  Gene Name: G protein-coupled receptor 141
  Uniprot ID: Q7Z602
  ENSP ID: ENSP00000334540
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFLFYVVILVTRYLIFFKCKDKVEFYRKLHAVAASAGMWTLVIVIVVPLVVSRYGIHEEYNEEHCFKFHKELAYTYVKIINYMIVIFVIAVAVILLVFQVFIIMLMVQKLRHSLLSHQEFWAQLKNLFFIGVILVCFLPYQFFRIYYLNVVTHSNACNSKVAFYNEIFLSVTAISCYDLLLFVFGGSHWFKQKIIGLWNCVLCR

SEQ ID NO: 33459 - protein, 305 aa, Homo sapiens; identical to SEQ ID NO: 33458
  Payload ID: 6566
  Gene Symbol: GPR141
  Gene Name: G protein-coupled receptor 141
  Uniprot ID: Q7Z602
  ENSP ID: ENSP00000390410

SEQ ID NO: 33460 - protein, 104 aa, Homo sapiens
  Payload ID: 6566
  Gene Symbol: GPR141
  Gene Name: G protein-coupled receptor 141
  ENSP ID: ENSP00000396300
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFL

SEQ ID NO: 33461 - protein, 462 aa, Homo sapiens
  Payload ID: 6567
  Gene Symbol: GPR142
  Gene Name: G protein-coupled receptor 142
  Uniprot ID: Q7Z601
  ENSP ID: ENSP00000335158
MSIMMLPMEQKIQWVPTSLQDITAVLGTEAYTEEDKSMVSHAQKSQHSCLSHSRWLRSPQVTGGSWDLRIRPSKDSSSFRQAQCLRKDPGANNHLESQGVRGTAGDADRELRGPSEKATAGQPRVTLLPTPHVSGLSQEFESHWPEIAERSPCVAGVIPVIYYSVLLGLGLPVSLLTAVALARLATRTRRPSYYYLLALTASDIIIQVVIVFAGFLLQGAVLARQVPQAVVRTANILEFAANHASVWIAILLTVDRYTALCHPLHHRAASSPGRTRRAIAAVLSAALLTGIPFYWWLDMWRDTDSPRTLDEVLKWAHCLTVYFIPCGVFLVTNSAIIHRLRRRGRSGLQPRVGKSTAILLGITTLFTLLWAPRVFVMLYHMYVAPVHRDWRVHLALDVANMVAMLHTAANFGLYCFVSKTFRATVRQVIHDAYLPCTLASQPEGMAAKPVMEPPGLPTGAEV

SEQ ID NO: 33462 - protein, 131 aa, Homo sapiens
  Payload ID: 6567
  Gene Symbol: GPR142
  Gene Name: G protein-coupled receptor 142
  ENSP ID: ENSP00000463521
MSIMMLPMEQKIQWVPTSLQDITAVLGTEAYTEEDKSMVSHAQKSQHSCLSHSRWLRSPQVTGGSWDLRIRPSKDSSSFRQAQCLRKDPGANNHLESQGVRGTAGDADRELRGPSEKATGDPGLRAPEHGA

SEQ ID NO: 33463 - protein, 101 aa, Homo sapiens
  Payload ID: 6567
  Gene Symbol: GPR142
  Gene Name: G protein-coupled receptor 142
  ENSP ID: ENSP00000464632
MSIMMLPMEQKIQWVPTSLQDITAVLGTEAYTEEDKSMVSHAQKSQHSCLSHSRWLRSPQVTGGSWDLRIRPSKDSSSFRQVNPAASQNRPSMGWDGSVSA

SEQ ID NO: 33464 - protein, 267 aa, Homo sapiens
  Payload ID: 6568
  Gene Symbol: GPR143
  Gene Name: G protein-coupled receptor 143
  ENSP ID: ENSP00000390546
MVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENP

SEQ ID NO: 33465 - protein, 171 aa, Homo sapiens
  Payload ID: 6568
  Gene Symbol: GPR143
  Gene Name: G protein-coupled receptor 143
  ENSP ID: ENSP00000406138
MVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLII

SEQ ID NO: 33466 - protein, 404 aa, Homo sapiens
  Payload ID: 6568
  Gene Symbol: GPR143
  Gene Name: G protein-coupled receptor 143
  Uniprot ID: P51810
  ENSP ID: ENSP00000417161
MASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 33467 - protein, 333 aa, Homo sapiens
  Payload ID: 6569
  Gene Symbol: GPR146
  Gene Name: G protein-coupled receptor 146
  Uniprot ID: Q96CH1
  ENSP ID: ENSP00000297468
MWSCSWFNGTGLVEELPACQDLQLGLSLLSLLGLVVGVPVGLCYNALLVLANLHSKASMTMPDVYFVNMAVAGLVLSALAPVHLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLPCGDRHCSPDHMGVQQVLA

SEQ ID NO: 33468 - protein, 333 aa, Homo sapiens; identical to SEQ ID NO: 33467
  Payload ID: 6569
  Gene Symbol: GPR146
  Gene Name: G protein-coupled receptor 146
  Uniprot ID: Q96CH1
  ENSP ID: ENSP00000380283

SEQ ID NO: 33469 - protein, 38 aa, Homo sapiens
  Payload ID: 6569
  Gene Symbol: GPR146
  Gene Name: G protein-coupled receptor 146
  ENSP ID: ENSP00000397853
MWSCSWFNGTGLVEELPACQDLQLGLSLLSLLGLVVGV

SEQ ID NO: 33470 - protein, 315 aa, Homo sapiens
  Payload ID: 6569
  Gene Symbol: GPR146
  Gene Name: G protein-coupled receptor 146
  ENSP ID: ENSP00000410743
MWSCSWFNGTGLVEELPACQDLQLGLSLLSLLGLVVGVPVGLCYNALLVLANLHSKASMTMPDVYFVNMAVAGLVLSALAPVHLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLP

SEQ ID NO: 33471 - protein, 347 aa, Homo sapiens
  Payload ID: 6570
  Gene Symbol: GPR148
  Gene Name: G protein-coupled receptor 148
  Uniprot ID: Q8TDV2
  ENSP ID: ENSP00000308908
MGDELAPCPVGTTAWPALIQLISKTPCMPQAASNTSLGLGDLRVPSSMLYWLFLPSSLLAAATLAVSPLLLVTILRNQRLRQEPHYLLPANILLSDLAYILLHMLISSSSLGGWELGRMACGILTDAVFAACTSTILSFTAIVLHTYLAVIHPLRYLSFMSHGAAWKAVALIWLVACCFPTFLIWLSKWQDAQLEEQGASYILPPSMGTQPGCGLLVIVTYTSILCVLFLCTALIANCFWRIYAEAKTSGIWGQGYSRARGTLLIHSVLITLYVSTGVVFSLDMVLTRYHHIDSGTHTWLLAANSEVLMMLPRAMLTYLYLLRYRQLLGMVRGHLPSRRHQAIFTIS

SEQ ID NO: 33472 - protein, 731 aa, Homo sapiens
  Payload ID: 6571
  Gene Symbol: GPR149
  Gene Name: G protein-coupled receptor 149
  Uniprot ID: Q86SP6
  ENSP ID: ENSP00000374390
MSLFLSNLSTNDSSLWKENHNSTDLLNPPGTLNIYLFCLTCLMTFAALVGSIYSLISLLKMQNRTVVSMLVASWSVDDLMSVLSVTIFMFLQWPNEVPGYFQFLCTTSALMYLCQGLSSNLKATLLVSYNFYTMHRGVGSQTASRRSGQVLGVVLTVWAASLLLSALPLCGWGAFVRTPWGCLVDCSSSYVLFLSIVYALAFGLLVGLSVPLTHRLLCSEEPPRLHSNYQEISRGASIPGTPPTAGRVVSLSPEDAPGPSLRRSGGCSPSSDTVFGPGAPAAAGAEACRRENRGTLYGTRSFTVSVAQKRFALILALTKVVLWLPMMMHMVVQNVVGFQSLPLETFSFLLTLLATTVTPVFVLSKRWTHLPCGCIINCRQNAYAVASDGKKIKRKGFEFNLSFQKSYGIYKIAHEDYYDDDENSIFYHNLMNSECETTKDPQRDNRNIFNAIKVEISTTPSLDSSTQRGINKCTNTDITEAKQDSNNKKDAFSDKTGGDINYEETTFSEGPERRLSHEESQKPDLSDWEWCRSKSERTPRQRSGYALAIPLCAFQGTVSLHAPTGKTLSLSTYEVSAEGQKITPASKKIEVYRSKSVGHEPNSEDSSSTFVDTSVKIHLEVLEICDNEEALDTVSIISNISQSSTQVRSPSLRYSRKENRFVSCDLGETASYSLFLPTSNPDGDINISIPDTVEAHRQNSKRQHQERDGYQEEIQLLNKAYRKREEESKGS

SEQ ID NO: 33473 - protein, 360 aa, Homo sapiens
  Payload ID: 6572
  Gene Symbol: GPR15
  Gene Name: G protein-coupled receptor 15
  Uniprot ID: P49685
  ENSP ID: ENSP00000284311
MDPEETSVYLDYYYATSPNSDIRETHSHVPYTSVFLPVFYTAVFLTGVLGNLVLMGALHFKPGSRRLIDIFIINLAASDFIFLVTLPLWVDKEASLGLWRTGSFLCKGSSYMISVNMHCSVLLLTCMSVDRYLAIVWPVVSRKFRRTDCAYVVCASIWFISCLLGLPTLLSRELTLIDDKPYCAEKKATPIKLIWSLVALIFTFFVPLLSIVTCYCCIARKLCAHYQQSGKHNKKLKKSIKIIFIVVAAFLVSWLPFNTFKFLAIVSGLRQEHYLPSAILQLGMEVSGPLAFANSCVNPFIYYIFDSYIRRAIVHCLCPCLKNYDFGSSTETSDSHLTKALSTFIHAEDFARRRKRSVSL

SEQ ID NO: 33474 - protein, 434 aa, Homo sapiens
  Payload ID: 6573
  Gene Symbol: GPR150
  Gene Name: G protein-coupled receptor 150
  Uniprot ID: Q8NGU9
  ENSP ID: ENSP00000369344
MEDLFSPSILPPAPNISVPILLGWGLNLTLGQGAPASGPPSRRVRLVFLGVILVVAVAGNTTVLCRLCGGGGPWAGPKRRKMDFLLVQLALADLYACGGTALSQLAWELLGEPRAATGDLACRFLQLLQASGRGASAHLVVLIALERRRAVRLPHGRPLPARALAALGWLLALLLALPPAFVVRGDSPSPLPPPPPPTSLQPGAPPAARAWPGERRCHGIFAPLPRWHLQVYAFYEAVAGFVAPVTVLGVACGHLLSVWWRHRPQAPAAAAPWSASPGRAPAPSALPRAKVQSLKMSLLLALLFVGCELPYFAARLAAAWSSGPAGDWEGEGLSAALRVVAMANSALNPFVYLFFQAGDCRLRRQLRKRLGSLCCAPQGGAEDEEGPRGHQALYRQRWPHPHYHHARREPLDEGGLRPPPPRPRPLPCSCESAF

SEQ ID NO: 33475 - protein, 419 aa, Homo sapiens
  Payload ID: 6574
  Gene Symbol: GPR151
  Gene Name: G protein-coupled receptor 151
  Uniprot ID: Q8TDV0
  ENSP ID: ENSP00000308733
MLAAAFADSNSSSMNVSFAHLHFAGGYLPSDSQDWRTIIPALLVAVCLVGFVGNLCVIGILLHNAWKGKPSMIHSLILNLSLADLSLLLFSAPIRATAYSKSVWDLGWFVCKSSDWFIHTCMAAKSLTIVVVAKVCFMYASDPAKQVSIHNYTIWSVLVAIWTVASLLPLPEWFFSTIRHHEGVEMCLVDVPAVAEEFMSMFGKLYPLLAFGLPLFFASFYFWRAYDQCKKRGTKTQNLRNQIRSKQVTVMLLSIAIISALLWLPEWVAWLWVWHLKAAGPAPPQGFIALSQVLMFSISSANPLIFLVMSEEFREGLKGVWKWMITKKPPTVSESQETPAGNSEGLPDKVPSPESPASIPEKEKPSSPSSGKGKTEKAEIPILPDVEQFWHERDTVPSVQDNDPIPWEHEDQETGEGVK

SEQ ID NO: 33476 - protein, 470 aa, Homo sapiens
  Payload ID: 6575
  Gene Symbol: GPR152
  Gene Name: G protein-coupled receptor 152
  Uniprot ID: Q8TDT2
  ENSP ID: ENSP00000310255
MDTTMEADLGATGHRPRTELDDEDSYPQGGWDTVFLVALLLLGLPANGLMAWLAGSQARHGAGTRLALLLLSLALSDFLFLAAAAFQILEIRHGGHWPLGTAACRFYYFLWGVSYSSGLFLLAALSLDRCLLALCPHWYPGHRPVRLPLWVCAGVWVLATLFSVPWLVFPEAAVWWYDLVICLDFWDSEELSLRMLEVLGGFLPFLLLLVCHVLTQATACRTCHRQQQPAACRGFARVARTILSAYVVLRLPYQLAQLLYLAFLWDVYSGYLLWEALVYSDYLILLNSCLSPFLCLMASADLRTLLRSVLSSFAAALCEERPGSFTPTEPQTQLDSEGPTLPEPMAEAQSQMDPVAQPQVNPTLQPRSDPTAQPQLNPTAQPQSDPTAQPQLNLMAQPQSDSVAQPQADTNVQTPAPAASSVPSPCDEASPTPSSHPTPGALEDPATPPASEGESPSSTPPEAAPGAGPT

SEQ ID NO: 33477 - protein, 609 aa, Homo sapiens
  Payload ID: 6576
  Gene Symbol: GPR153
  Gene Name: G protein-coupled receptor 153
  Uniprot ID: Q6NV75
  ENSP ID: ENSP00000367125
MSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPVNYRLSNAKKQAVHTVMGIWMVSFILSALPAVGWHDTSERFYTHGCRFIVAEIGLGFGVCFLLLVGGSVAMGVICTAIALFQTLAVQVGRQADRRAFTVPTIVVEDAQGKRRSSIDGSEPAKTSLQTTGLVTTIVFIYDCLMGFPVLVVSFSSLRADASAPWMALCVLWCSVAQALLLPVFLWACDRYRADLKAVREKCMALMANDEESDDETSLEGGISPDLVLERSLDYGYGGDFVALDRMAKYEISALEGGLPQLYPLRPLQEDKMQYLQVPPTRRFSHDDADVWAAVPLPAFLPRWGSGEDLAALAHLVLPAGPERRRASLLAFAEDAPPSRARRRSAESLLSLRPSALDSGPRGARDSPPGSPRRRPGPGPRSASASLLPDAFALTAFECEPQALRRPPGPFPAAPAAPDGADPGEAPTPPSSAQRSPGPRPSAHSHAGSLRPGLSASWGEPGGLRAAGGGGSTSSFLSSPSESSGYATLHSDSLGSAS

SEQ ID NO: 33478 - protein, 870 aa, Homo sapiens
  Payload ID: 6577
  Gene Symbol: GPR155
  Gene Name: G protein-coupled receptor 155
  Uniprot ID: Q7Z3F1
  ENSP ID: ENSP00000295500
MNSNLPAENLTIAVNMTKTLPTAVTHGFNSTNDPPSMSITRLFPALLECFGIVLCGYIAGRANVITSTQAKGLGNFVSRFALPALLFKNMVVLNFSNVDWSFLYSILIAKASVFFIVCVLTLLVASPDSRFSKAGLFPIFATQSNDFALGYPIVEALYQTTYPEYLQYIYLVAPISLMMLNPIGFIFCEIQKWKDTQNASQNKIKIVGLGLLRVLQNPIVFMVFIGIAFNFILDRKVPVYVENFLDGLGNSFSGSALFYLGLTMVGKIKRLKKSAFVVLILLITAKLLVLPLLCREMVELLDKGDSVVNHTSLSNYAFLYGVFPVAPGVAIFATQFNMEVEIITSGMVISTFVSAPIMYVSAWLLTFPTMDPKPLAYAIQNVSFDISIVSLISLIWSLAILLLSKKYKQLPHMLTTNLLIAQSIVCAGMMIWNFVKEKNFVGQILVFVLLYSSLYSTYLWTGLLAISLFLLKKRERVQIPVGIIIISGWGIPALLVGVLLITGKHNGDSIDSAFFYGKEQMITTAVTLFCSILIAGISLMCMNQTAQAGSYEGFDQSQSHKVVEPGNTAFEESPAPVNEPELFTSSIPETSCCSCSMGNGELHCPSIEPIANTSTSEPVIPSFEKNNHCVSRCNSQSCILAQEEEQYLQSGDQQLTRHVLLCLLLIIGLFANLSSCLWWLFNQEPGRLYVELQFFCAVFNFGQGFISFGIFGLDKHLIILPFKRRLEFLWNNKDTAENRDSPVSEEIKMTCQQFIHYHRDLCIRNIVKERRCGAKTSAGTFCGCDLVSWLIEVGLASDRGEAVIYGDRLVQGGVIQHITNEYEFRDEYLFYRFLQKSPEQSPPAINANTLQQERYKEIEHSSPPSHSPKT

SEQ ID NO: 33479 - protein, 870 aa, Homo sapiens; identical to SEQ ID NO: 33478
  Payload ID: 6577
  Gene Symbol: GPR155
  Gene Name: G protein-coupled receptor 155
  Uniprot ID: Q7Z3F1
  ENSP ID: ENSP00000376334

SEQ ID NO: 33480 - protein, 870 aa, Homo sapiens; identical to SEQ ID NO: 33478
  Payload ID: 6577
  Gene Symbol: GPR155
  Gene Name: G protein-coupled receptor 155
  Uniprot ID: Q7Z3F1
  ENSP ID: ENSP00000376335

SEQ ID NO: 33481 - protein, 842 aa, Homo sapiens
  Payload ID: 6577
  Gene Symbol: GPR155
  Gene Name: G protein-coupled receptor 155
  ENSP ID: ENSP00000481104
MNSNLPAENLTIAVNMTKTLPTAVTHGFNSTNDPPSMSITRLFPALLECFGIVLCGYIAGRANVITSTQAKGLGNFVSRFALPALLFKNMVVLNFSNVDWSFLYSILIAKASVFFIVCVLTLLVASPDSRFSKAGLFPIFATQSNDFALGYPIVEALYQTTYPEYLQYIYLVAPISLMMLNPIGFIFCEIQKWKDTQNASQNKIKIVGLGLLRVLQNPIVFMVFIGIAFNFILDRKVPVYVENFLDGLGNSFSGSALFYLGLTMVGKIKRLKKSAFVVLILLITAKLLVLPLLCREMVELLDKGDSVVNHTSLSNYAFLYGVFPVAPGVAIFATQFNMEVEIITSGMVISTFVSAPIMYVSAWLLTFPTMDPKPLAYAIQNVSFDISIVSLISLSIVCAGMMIWNFVKEKNFVGQILVFVLLYSSLYSTYLWTGLLAISLFLLKKRERVQIPVGIIIISGWGIPALLVGVLLITGKHNGDSIDSAFFYGKEQMITTAVTLFCSILIAGISLMCMNQTAQAGSYEGFDQSQSHKVVEPGNTAFEESPAPVNEPELFTSSIPETSCCSCSMGNGELHCPSIEPIANTSTSEPVIPSFEKNNHCVSRCNSQSCILAQEEEQYLQSGDQQLTRHVLLCLLLIIGLFANLSSCLWWLFNQEPGRLYVELQFFCAVFNFGQGFISFGIFGLDKHLIILPFKRRLEFLWNNKDTAENRDSPVSEEIKMTCQQFIHYHRDLCIRNIVKERRCGAKTSAGTFCGCDLVSWLIEVGLASDRGEAVIYGDRLVQGGVIQHITNEYEFRDEYLFYRFLQKSPEQSPPAINANTLQQERYKEIEHSSPPSHSPKT

SEQ ID NO: 33482 - protein, 814 aa, Homo sapiens
  Payload ID: 6578
  Gene Symbol: GPR156
  Gene Name: G protein-coupled receptor 156
  Uniprot ID: Q8NFN8
  ENSP ID: ENSP00000324553
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 33483 - protein, 78 aa, Homo sapiens
  Payload ID: 6578
  Gene Symbol: GPR156
  Gene Name: G protein-coupled receptor 156
  ENSP ID: ENSP00000417191
MEPEINCSELCDSFPGQELDRRPLHDLCKTTITSSHHSSKTISSLSPVLLGIVWTFLSCGLLLILFFLAFTIHCRKNS

SEQ ID NO: 33484 - protein, 814 aa, Homo sapiens; identical to SEQ ID NO: 33482
  Payload ID: 6578
  Gene Symbol: GPR156
  Gene Name: G protein-coupled receptor 156
  Uniprot ID: Q8NFN8
  ENSP ID: ENSP00000417261

SEQ ID NO: 33485 - protein, 810 aa, Homo sapiens
  Payload ID: 6578
  Gene Symbol: GPR156
  Gene Name: G protein-coupled receptor 156
  Uniprot ID: Q8NFN8
  ENSP ID: ENSP00000418758
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 33486 - protein, 335 aa, Homo sapiens
  Payload ID: 6579
  Gene Symbol: GPR157
  Gene Name: G protein-coupled receptor 157
  Uniprot ID: Q5UAW9
  ENSP ID: ENSP00000366628
MQPSPPPTELVPSERAVVLLSCALSALGSGLLVATHALWPDLRSRARRLLLFLSLADLLSAASYFYGVLQNFAGPSWDCVLQGALSTFANTSSFFWTVAIALYLYLSIVRAARGPRTDRLLWAFHVVSWGVPLVITVAAVALKKIGYDASDVSVGWCWIDLEAKDHVLWMLLTGKLWEMLAYVLLPLLYLLVRKHINRAHTALSEYRPILSQEHRLLRHSSMADKKLVLIPLIFIGLRVWSTVRFVLTLCGSPAVQTPVLVVLHGIGNTFQGGANCIMFVLCTRAVRTRLFSLCCCCCSSQPPTKSPAGTPKAPAPSKPGESQESQGTPGELPST

SEQ ID NO: 33487 - protein, 66 aa, Homo sapiens
  Payload ID: 6579
  Gene Symbol: GPR157
  Gene Name: G protein-coupled receptor 157
  ENSP ID: ENSP00000468362
  MOD_RES (1)..(1): Any amino acid
XWMLLTGKLWEMLAYVLLPLLYLLVRKHINRAGIGNTFQGGANCIMFVLCTRAVRTRLFSLCCCCC

SEQ ID NO: 33488 - protein, 1215 aa, Homo sapiens
  Payload ID: 6580
  Gene Symbol: GPR158
  Gene Name: G protein-coupled receptor 158
  Uniprot ID: Q5T848
  ENSP ID: ENSP00000365529
MGAMAYPLLLCLLLAQLGLGAVGASRDPQGRPDSPRERTPKGKPHAQQPGRASASDSSAPWSRSTDGTILAQKLAEEVPMDVASYLYTGDSHQLKRANCSGRYELAGLPGKWPALASAHPSLHRALDTLTHATNFLNVMLQSNKSREQNLQDDLDWYQALVWSLLEGEPSISRAAITFSTDSLSAPAPQVFLQATREESRILLQDLSSSAPHLANATLETEWFHGLRRKWRPHLHRRGPNQGPRGLGHSWRRKDGLGGDKSHFKWSPPYLECENGSYKPGWLVTLSSAIYGLQPNLVPEFRGVMKVDINLQKVDIDQCSSDGWFSGTHKCHLNNSECMPIKGLGFVLGAYECICKAGFYHPGVLPVNNFRRRGPDQHISGSTKDVSEEAYVCLPCREGCPFCADDSPCFVQEDKYLRLAIISFQALCMLLDFVSMLVVYHFRKAKSIRASGLILLETILFGSLLLYFPVVILYFEPSTFRCILLRWARLLGFATVYGTVTLKLHRVLKVFLSRTAQRIPYMTGGRVMRMLAVILLVVFWFLIGWTSSVCQNLEKQISLIGQGKTSDHLIFNMCLIDRWDYMTAVAEFLFLLWGVYLCYAVRTVPSAFHEPRYMAVAVHNELIISAIFHTIRFVLASRLQSDWMLMLYFAHTHLTVTVTIGLLLIPKFSHSSNNPRDDIATEAYEDELDMGRSGSYLNSSINSAWSEHSLDPEDIRDELKKLYAQLEIYKRKKMITNNPHLQKKRCSKKGLGRSIMRRITEIPETVSRQCSKEDKEGADHGTAKGTALIRKNPPESSGNTGKSKEETLKNRVFSLKKSHSTYDHVRDQTEESSSLPTESQEEETTENSTLESLSGKKLTQKLKEDSEAESTESVPLVCKSASAHNLSSEKKTGHPRTSMLQKSLSVIASAKEKTLGLAGKTQTAGVEERTKSQKPLPKDKETNRNHSNSDNTETKDPAPQNSNPAEEPRKPQKSGIMKQQRVNPTTANSDLNPGTTQMKDNFDIGEVCPWEVYDLTPGPVPSESKVQKHVSIVASEMEKNPTFSLKEKSHHKPKAAEVCQQSNQKRIDKAEVCLWESQGQSILEDEKLLISKTPVLPERAKEENGGQPRAANVCAGQSEELPPKAVASKTENENLNQIGHQEKKTSSSEENVRGSYNSSNNFQQPLTSRAEVCPWEFETPAQPNAGRSVALPASSALSANKIAGPRKEEIWDSFKV

SEQ ID NO: 33489 - protein, 338 aa, Homo sapiens
  Payload ID: 6581
  Gene Symbol: GPR160
  Gene Name: G protein-coupled receptor 160
  Uniprot ID: Q9UJ42
  ENSP ID: ENSP00000348161
MTALSSENCSFQYQLRQTNQPLDVNYLLFLIILGKILLNILTLGMRRKNTCQNFMEYFCISLAFVDLLLLVNISIILYFRDFVLLSIRFTKYHICLFTQIISFTYGFLHYPVFLTACIDYCLNFSKTTKLSFKCQKLFYFFTVILIWISVLAYVLGDPAIYQSLKAQNAYSRHCPFYVSIQSYWLSFFMVMILFVAFITCWEEVTTLVQAIRITSYMNETILYFPFSSHSSYTVRSKKIFLSKLIVCFLSTWLPFVLLQVIIVLLKVQIPAYIEMNIPWLYFVNSFLIATVYWFNCHKLNLKDIGLPLDPFVNWKCCFIPLTIPNLEQIEKPISIMIC

SEQ ID NO: 33490 - protein, 33 aa, Homo sapiens
  Payload ID: 6581
  Gene Symbol: GPR160
  Gene Name: G protein-coupled receptor 160
  ENSP ID: ENSP00000418531
MTALSSENCSFQYQLRQTNQPLDVNYLLFLIIL

SEQ ID NO: 33491 - protein, 88 aa, Homo sapiens
  Payload ID: 6581
  Gene Symbol: GPR160
  Gene Name: G protein-coupled receptor 160
  ENSP ID: ENSP00000419400
MTALSSENCSFQYQLRQTNQPLDVNYLLFLIILGKILLNILTLGMRRKNTCQNFMEYFCISLAFVDLLLLVNISIILYFRDFVLLSIR

SEQ ID NO: 33492 - protein, 163 aa, Homo sapiens
  Payload ID: 6581
  Gene Symbol: GPR160
  Gene Name: G protein-coupled receptor 160
  ENSP ID: ENSP00000419546
MTALSSENCSFQYQLRQTNQPLDVNYLLFLIILGKILLNILTLGMRRKNTCQNFMEYFCISLAFVDLLLLVNISIILYFRDFVLLSIRFTKYHICLFTQIISFTYGFLHYPVFLTACIDYCLNFSKTTKLSFKCQKLFYFFTVILIWISVLAYVLGDPAIYQS

SEQ ID NO: 33493 - protein, 143 aa, Homo sapiens
  Payload ID: 6581
  Gene Symbol: GPR160
  Gene Name: G protein-coupled receptor 160
  ENSP ID: ENSP00000420751
MTALSSENCSFQYQLRQTNQPLDVNYLLFLIILGKILLNILTLGMRRKNTCQNFMEYFCISLAFVDLLLLVNISIILYFRDFVLLSIRFTKYHICLFTQIISFTYGFLHYPVFLTACIDYCLNFSKTTKLSFKCQKLFYFFTV

SEQ ID NO: 33494 - protein, 546 aa, Homo sapiens
  Payload ID: 6582
  Gene Symbol: GPR161
  Gene Name: G protein-coupled receptor 161
  ENSP ID: ENSP00000271357
MKVVQHALPTPRRGALTMSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 33495 - protein, 529 aa, Homo sapiens
  Payload ID: 6582
  Gene Symbol: GPR161
  Gene Name: G protein-coupled receptor 161
  Uniprot ID: Q8N6U8
  ENSP ID: ENSP00000356809
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 33496 - protein, 397 aa, Homo sapiens
  Payload ID: 6582
  Gene Symbol: GPR161
  Gene Name: G protein-coupled receptor 161
  Uniprot ID: Q8N6U8
  ENSP ID: ENSP00000356810
MVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 33497 - protein, 529 aa, Homo sapiens; identical to SEQ ID NO: 33495
  Payload ID: 6582
  Gene Symbol: GPR161
  Gene Name: G protein-coupled receptor 161
  Uniprot ID: Q8N6U8
  ENSP ID: ENSP00000356812

SEQ ID NO: 33498 - protein, 451 aa, Homo sapiens
  Payload ID: 6582
  Gene Symbol: GPR161
  Gene Name: G protein-coupled receptor 161
  Uniprot ID: Q8N6U8
  ENSP ID: ENSP00000437576
MGGRRCVPGTLPMRAAPPGAKRLHVPLRAKGVGRSGHAPRLESVRTSYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 33499 - protein, 549 aa, Homo sapiens
  Payload ID: 6582
  Gene Symbol: GPR161
  Gene Name: G protein-coupled receptor 161
  Uniprot ID: Q8N6U8
  ENSP ID: ENSP00000441039
MSARGVVQHALPTPRRGALTMSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 33500 - protein, 415 aa, Homo sapiens
  Payload ID: 6582
  Gene Symbol: GPR161
  Gene Name: G protein-coupled receptor 161
  Uniprot ID: Q8N6U8
  ENSP ID: ENSP00000444348
MLVPVGWMNESYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 33501 - protein, 588 aa, Homo sapiens
  Payload ID: 6583
  Gene Symbol: GPR162
  Gene Name: G protein-coupled receptor 162
  Uniprot ID: Q16538
  ENSP ID: ENSP00000311528
MARGGAGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 33502 - protein, 284 aa, Homo sapiens
  Payload ID: 6583
  Gene Symbol: GPR162
  Gene Name: G protein-coupled receptor 162
  ENSP ID: ENSP00000371752
MVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 33503 - protein, 304 aa, Homo sapiens
  Payload ID: 6583
  Gene Symbol: GPR162
  Gene Name: G protein-coupled receptor 162
  Uniprot ID: Q16538
  ENSP ID: ENSP00000399670
MLSTGVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 33504 - protein, 228 aa, Homo sapiens
  Payload ID: 6583
  Gene Symbol: GPR162
  Gene Name: G protein-coupled receptor 162
  ENSP ID: ENSP00000475912
  MOD_RES (1)..(1): Any amino acid
XITFYQTLWARPRRARQARRVGGGGGTKAGGPGALGTRPAFEVPAIVVEDARGKRRSSLDGSESAKTSLQVTNLVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQLKKLDLAAAAAHTFFVANPMHLQMREDMAKYRRMSGVR

SEQ ID NO: 33505 - protein, 367 aa, Homo sapiens
  Payload ID: 6584
  Gene Symbol: GPR17
  Gene Name: G protein-coupled receptor 17
  Uniprot ID: Q13304
  ENSP ID: ENSP00000272644
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEKRLKTKAVRMIAIVLAIFLVCFVPYHVNRSVYVLHYRSHGASCATQRILALANRITSCLTSLNGALDPIMYFFVAEKFRHALCNLLCGKRLKGPPPSFEGKTNESSLSAKSEL

SEQ ID NO: 33506 - protein, 367 aa, Homo sapiens; identical to SEQ ID NO: 33505
  Payload ID: 6584
  Gene Symbol: GPR17
  Gene Name: G protein-coupled receptor 17
  Uniprot ID: Q13304
  ENSP ID: ENSP00000376741

SEQ ID NO: 33507 - protein, 136 aa, Homo sapiens
  Payload ID: 6584
  Gene Symbol: GPR17
  Gene Name: G protein-coupled receptor 17
  ENSP ID: ENSP00000387970
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTG

SEQ ID NO: 33508 - protein, 367 aa, Homo sapiens; identical to SEQ ID NO: 33505
  Payload ID: 6584
  Gene Symbol: GPR17
  Gene Name: G protein-coupled receptor 17
  Uniprot ID: Q13304
  ENSP ID: ENSP00000442982

SEQ ID NO: 33509 - protein, 319 aa, Homo sapiens
  Payload ID: 6585
  Gene Symbol: GPR171
  Gene Name: G protein-coupled receptor 171
  Uniprot ID: O14626
  ENSP ID: ENSP00000308479
MTNSSFFCPVYKDLEPFTYFFYLVFLVGIIGSCFATWAFIQKNTNHRCVSIYLINLLTADFLLTLALPVKIVVDLGVAPWKLKIFHCQVTACLIYINMYLSIIFLAFVSIDRCLQLTHSCKIYRIQEPGFAKMISTVVWLMVLLIMVPNMMIPIKDIKEKSNVGCMEFKKEFGRNWHLLTNFICVAIFLNFSAIILISNCLVIRQLYRNKDNENYPNVKKALINILLVTTGYIICFVPYHIVRIPYTLSQTEVITDCSTRISLFKAKEATLLLAVSNLCFDPILYYHLSKAFRSKVTETFASPKETKAQKEKLRCENNA

SEQ ID NO: 33510 - protein, 18 aa, Homo sapiens
  Payload ID: 6585
  Gene Symbol: GPR171
  Gene Name: G protein-coupled receptor 171
  ENSP ID: ENSP00000420109
MTNSSFFCPVYKDLEPFT

SEQ ID NO: 33511 - protein, 319 aa, Homo sapiens; identical to SEQ ID NO: 33509
  Payload ID: 6585
  Gene Symbol: GPR171
  Gene Name: G protein-coupled receptor 171
  Uniprot ID: O14626
  ENSP ID: ENSP00000482588

SEQ ID NO: 33512 - protein, 373 aa, Homo sapiens
  Payload ID: 6586
  Gene Symbol: GPR173
  Gene Name: G protein-coupled receptor 173
  Uniprot ID: Q9NS66
  ENSP ID: ENSP00000331600
MANTTGEPEEVSGALSPPSASAYVKLVLLGLIMCVSLAGNAILSLLVLKERALHKAPYYFLLDLCLADGIRSAVCFPFVLASVRHGSSWTFSALSCKIVAFMAVLFCFHAAFMLFCISVTRYMAIAHHRFYAKRMTLWTCAAVICMAWTLSVAMAFPPVFDVGTYKFIREEDQCIFEHRYFKANDTLGFMLMLAVLMAATHAVYGKLLLFEYRHRKMKPVQMVPAISQNWTFHGPGATGQAAANWIAGFGRGPMPPTLLGIRQNGHAASRRLLGMDEVKGEKQLGRMFYAITLLFLLLWSPYIVACYWRVFVKACAVPHRYLATAVWMSFAQAAVNPIVCFLLNKDLKKCLRTHAPCWGTGGAPAPREPYCVM

SEQ ID NO: 33513 - protein, 52 aa, Homo sapiens
  Payload ID: 6586
  Gene Symbol: GPR173
  Gene Name: G protein-coupled receptor 173
  ENSP ID: ENSP00000364615
MANTTGEPEEVSGALSPPSASAYVKLVLLGLIMCVSLAGNAILSLLVLKERA

SEQ ID NO: 33514 - protein, 333 aa, Homo sapiens
  Payload ID: 6587
  Gene Symbol: GPR174
  Gene Name: G protein-coupled receptor 174
  Uniprot ID: Q9BXC1
  ENSP ID: ENSP00000276077
MPANYTCTRPDGDNTDFRYFIYAVTYTVILVPGLIGNILALWVFYGYMKETKRAVIFMINLAIADLLQVLSLPLRIFYYLNHDWPFGPGLCMFCFYLKYVNMYASIYFLVCISVRRFWFLMYPFRFHDCKQKYDLYISIAGWLIICLACVLFPLLRTSDDTSGNRTKCFVDLPTRNVNLAQSVVMMTIGELIGFVTPLLIVLYCTWKTVLSLQDKYPMAQDLGEKQKALKMILTCAGVFLICFAPYHFSFPLDFLVKSNEIKSCLARRVILIFHSVALCLASLNSCLDPVIYYFSTNEFRRRLSRQDLHDSIQLHAKSFVSNHTASTMTPELC

SEQ ID NO: 33515 - protein, 514 aa, Homo sapiens
  Payload ID: 6588
  Gene Symbol: GPR176
  Gene Name: G protein-coupled receptor 176
  ENSP ID: ENSP00000299092
MGHNGSWISPNASEPHNASGAEAAGVNRSALGEFGEAQLYRQFTTTVQVVIFIGSLLEFGNMEVTRKLDKSRLPGIKFIKNLACSGICASLVCVPFDIILSTSPHCCWWIYTMLFCKVVKFLHKVFCSVTILSFPAIALDRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 33516 - protein, 470 aa, Homo sapiens
  Payload ID: 6588
  Gene Symbol: GPR176
  Gene Name: G protein-coupled receptor 176
  ENSP ID: ENSP00000439361
MPAPLLLISRTLGNFMVLWSTCRTTVFKSVTNRFIKNLACSGICASLVCVPFDIILSTSPHCCWWIYTMLFCKVVKFLHKVFCSVTILSFPAIALDRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 33517 - protein, 515 aa, Homo sapiens
  Payload ID: 6588
  Gene Symbol: GPR176
  Gene Name: G protein-coupled receptor 176
  Uniprot ID: Q14439
  ENSP ID: ENSP00000453076
MGHNGSWISPNASEPHNASGAEAAGVNRSALGEFGEAQLYRQFTTTVQVVIFIGSLLGNFMVLWSTCRTTVFKSVTNRFIKNLACSGICASLVCVPFDIILSTSPHCCWWIYTMLFCKVVKFLHKVFCSVTILSFPAIALDRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 33518 - protein, 2368 aa, Homo sapiens [sequence omitted]

SEQ ID NO: 33519 - protein, 2367 aa, Homo sapiens
  Payload ID: 6589
  Gene Symbol: GPR179
  Gene Name: G protein-coupled receptor 179
  ENSP ID: ENSP00000483469
MGTRGAVMPPPMWGLLGCCFVCAWALGGPRPIRSLPPLSSQVKPGSVPMQVPLEGAEAALAYLYSGDAQQLSQVNCSERYEARGAGAMPGLPPSLQGAAGTLAQAANFLNMLLQANDIRESSVEEDVEWYQALVRSVAEGDPRVYRALLTFNPPPGASHLQLALQATRTGEETILQDLSGNWVQEENPPGDLDTPALKKRVLTNDLGSLGSPKWPQADGYVGDTQQVRLSPPFLECQEGRLRPGWLITLSATFYGLKPDLSPEVRGQVQMDVDLQSVDINQCASGPGWYSNTHLCDLNSTQCVPLESQGFVLGRYLCRCRPGFYGASPSGGLEESDFQTTGQFGFPEGRSGRLLQCLPCPEGCTSCMDATPCLVEEAAVLRAAVLACQACCMLAIFLSMLVSYRCRRNKRIWASGVVLLETVLFGFLLLYFPVFILYFKPSVFRCIALRWVRLLGFAIVYGTIILKLYRVLQLFLSRTAQRSALLSSGRLLRHLGLLLLPVLGFLAVWTVGALERGIQHAPLVIRGHTPSGRHFYLCHHDRWDYIMVVAELLLLCWGSFLCYATRAVLSAFHEPRYMGIALHNELLLSAAFHTARFVLVPSLHPDWTLLLFFFHTHSTVTTTLALIFIPKFWKLGAPPREEMVDEVCEDELDLQHSGSYLGSSIASAWSEHSLDPGDIRDELKKLYAQLEVHKTKEMAANNPHLPKKRGSSCQGLGRSFMRYLAEFPEALARQHSRDSGSPGHGSLPGSSRRRLLSSSLQEPEGTPALHKSRSTYDQRREQDPPLLDSLLRRKLAKKASRTESRESVEGPPALGFRSASAHNLTVGERLPRARPASLQKSLSVASSREKALLMASQAYLEETYRQAKEREERKKAKAAMASLVRRPSARRLERPRGAPLSAPPSPAKSSSVDSSHTSGRLHEEARRRLPHPPIRHQVSTPILALSGGLGEPRMLSPTSTLAPALLPALAPTPAPALAPVPVSPQSPNLLTYICPWENAELPAKQENVPQEGPSGPERGHHSPAPARARLWRALSVAVEKSRAGENEMDAEDAHHQREANDVDEDRPKIFPKSHSLKAPVQQGSMRSLGLAIKALTRSRSTYREKESVEESPEGQNSGTAGESMGAPSRSPRLGRPKAVSKQAALIPSDDKESLQNQQNAHTSRMLQVCQREGSREQEDRGRRMTQGLGERKAERAGKTGLAMLRQVSRDKNIKQSKETPVGWQELPKAGLQSLGSADHRVAEVCPWEVTESETRQPDSGNKAEICPWETSEGAPESRALRQDPGDSQKKRGEARGKSEPIDVVPMMRKKPERLVREQEAVCPWESADRGGLSPGSAPQDPGRIRDKSEAGDSVEARKVEKPGWEAAGPEAHTPDITKAEPCPWEASEGGEDGKPAQEAVKDLPQEKQKTRKATFWKEQKPGGDLESLCPWESTDFRGPSAVSIQAPGSSECSGSLGSGIAEVCLWEAGDAPAIQKAEICPWELDDNVMGQEMLSLGTGRESLQEKEKASRKGSFGEMGEQTVKAVQKLSQQQESVCPRESTVPGHSSPCLDNSSSKAGSQFLCNGGSRATQVCPQEDLRPEAQEATPAKTEICPWEVNERTREEWTSAQVPRGGESQKDKEKMPGKSEIEDVTAWEKPEGQIQKQEAVGPWESVDPGSFSPQPRPQDTERPQTLLQMSGSVGSKAADICPLDVEENLTAGKAEICPWEVGAGAGEERALGAEAIRKSPNDTGKVSADLGPRERAVTAPEKPQKPTPEWEVACPWGSVGPGACSQHPGTLDADGPKAGFQELDHMGCRPGEVCPWEAQEAATSEKAKICPWEVSEGTTGKGLDQKAGSESAEQREKALEKGRLTSLGEDVSKGMAKLCQQQETICIWENKDLRESPAQAPKISDLPSSMSSEVAEGHSLEATEKGDLRQDPKTGSFPEHITQEKAPAADTEEFTTEDGEKTSHELQSVCPWETTAPADSVSHLDRQRPDQPKASSQRLVSTGGRAADVCPWDVPDAGVYKSDSSAKAETCPWEVTERIPVKGVSRQDGKGDSQEEKGRAPEKSEPKGVPVQKKPEMADFRQQEAVCPWESQDGKGLSPQPAPDASDRSRGSSEAAGSVETRVAEVCLWEVVEAPSAKKAEICPWEAGGGAAEEGEQERESQGQGEMFLQKAGPGGTEEHFSKAAAKPREQEAVCPGEGTGSGGLLPQSGALDPELKVSPKEAGSMGSRMAELCQWEITDPEGNKIKGTMADICPGEETGVPSEESGLLALTATRREFFPTAPEKPLCLLVHGPLDHFFPESKIPCPKVSRPASTFTLEGVRELQGPSGLEPRTSLAPEPSLQEAESQSSSLTEDSGQVAFEAQYEEFTPPTVYPWDWE

SEQ ID NO: 33520 - protein, 2367 aa, Homo sapiens
  Payload ID: 6589
  Gene Symbol: GPR179
  Gene Name: G protein-coupled receptor 179
  Uniprot ID: Q6PRD1
  ENSP ID: ENSP00000484951
MGTRGAVMPPPMWGLLGCCFVCAWALGGPRPIRSLPPLSSQVKPGSVPMQVPLEGAEAALAYLYSGDAQQLSQVNCSERYEARGAGAMPGLPPSLQGAAGTLAQAANFLNMLLQANDIRESSVEEDVEWYQALVRSVAEGDPRVYRALLTFNPPPGASHLQLALQATRTGEETILQDLSGNWVQEENPPGDLDTPALKKRVLTNDLGSLGSPKWPQADGYVGDTQQVRLSPPFLECQEGRLRPGWLITLSATFYGLKPDLSPEVRGQVQMDVDLQSVDINQCASGPGWYSNTHLCDLNSTQCVPLESQGFVLGRYLCRCRPGFYGASPSGGLEESDFQTTGQFGFPEGRSGRLLQCLPCPEGCTSCMDATPCLVEEAAVLRAAVLACQACCMLAIFLSMLVSYRCRRNKRIWASGVVLLETVLFGFLLLYFPVFILYFKPSVFRCIALRWVRLLGFAIVYGTIILKLYRVLQLFLSRTAQRSALLSSGRLLRRLGLLLLPVLGFLAVWTVGALERGIQHAPLVIRGHTPSGRHFYLCHHDRWDYIMVVAELLLLCWGSFLCYATRAVLSAFHEPRYMGIALHNELLLSAAFHTARFVLVPSLHPDWTLLLFFFHTHSTVTTTLALIFIPKFWKLGAPPREEMVDEVCEDELDLQHSGSYLGSSIASAWSEHSLDPGDIRDELKKLYAQLEVHKTKEMAANNPHLPKKRGSSCQGLGRSFMRYLAEFPEALARQHSRDSGSPGHGSLPGSSRRRLLSSSLQEPEGTPALHKSRSTYDQRREQDPPLLDSLLRRKLAKKASRTESRESVEGPPALGFRSASAHNLTVGERLPRARPASLQKSLSVASSREKALLMASQAYLEETYRQAKEREERKKAKAAMASLVRRPSARRLERPRGAPLSAPPSPAKSSSVDSSHTSGRLHEEARRRLPHPPIRHQVSTPILALSGGLGEPRMLSPTSTLAPALLPALAPTPAPALAPVPVSPQSPNLLTYICPWENAELPAKQENVPQEGPSGPERGHHSPAPARARLWRALSVAVEKSRAGENEMDAEDAHHQREANDVDEDRPKIFPKSHSLKAPVQQGSMRSLGLAIKALTRSRSTYREKESVEESPEGQNSGTAGESMGAPSRSPRLGRPKAVSKQAALIPSDDKESLQNQQNAHTSRMLQVCQREGSREQEDRGRRMTQGLGERKAERAGKTGLAMLRQVSRDKNIKQSKETPVGWQELPKAGLQSLGSADHRVAEVCPWEVTESETRQPDSGNKAEICPWETSEGAPESRALRQDPGDSQKKRGEARGKSEPIDVVPMMRKKPERLVREQEAVCPWESADRGGLSPGSAPQDPGRIRDKSEAGDSVEARKVEKPGWEAAGPEAHTPDITKAEPCPWEASEGGEDGKPAQEAVKDLPQEKQKTRKATFWKEQKPGGDLESLCPWESTDFRGPSAVSIQAPGSSECSGSLGSGIAEVCLWEAGDAPAIQKAEICPWELDDNVMGQEMLSLGTGRESLQEKEKASRKGSFGEMGEQTVKAVQKLSQQQESVCPRESTVPGHSSPCLDNSSSKAGSQFLCNGGSRATQVCPQEDLRPEAQEATPAKTEICPWEVNERTREEWTSAQVPRGGESQKDKEKMPGKSEIEDVTAWEKPEGQIQKQEAVGPWESVDPGSFSPQPRPQDTERPQTLLQMSGSVGSKAADICPLDVEENLTAGKAEICPWEVGAGAGEERALGAEAIRKSPNDTGKVSADLGPRERAVTAPEKPQKPTPEWEVACPWGSVGPGACSQHPGTLDADGPKAGFQELDHMGCRPGEVCPWEAQEAATSEKAKICPWEVSEGTTGKGLDQKAGSESAEQREKALEKGRLTSLGEDVSKGMAKLCQQQETICIWENKDLRESPAQAPKISDLPSSMSSEVAEGHSLEATEKGDLRQDPKTGSFPEHITQEKAPAADTEEFTTEDGEKTSHELQSVCPWETTAPADSVSHLDRQRPDQPKASSQRLVSTGGRAADVCPWDVPDAGVYKSDSSAKAETCPWEVTERIPVKGVSRQDGKGDSQEEKGRAPEKSEPKGVPVQKKPEMADFRQQEAVCPWESQDGKGLSPQPAPDASDRSRGSSEAAGSVETRVAEVCLWEVVEAPSAKKAEICPWEAGGGAAEEGEQERESQGQGEMFLQKAGPGGTEEHFSKAAAKPREQEAVCPGEGTGSGGLLPQSGALDPELKVSPKEAGSMGSRMAELCQWEITDPEGNKIKGTMADICPGEETGVPSEESGLLALTATRREFFPTAPEKPLCLLVHGPLDHFFPESKIPCPKVSRPASTFTLEGVRELQGPSGLEPRTSLAPEPSLQEAESQSSSLTEDSGQVAFEAQYEEFTPPTVYPWDWE

SEQ ID NO: 33521 - protein, 331 aa, Homo sapiens
  Payload ID: 6590
  Gene Symbol: GPR18
  Gene Name: G protein-coupled receptor 18
  Uniprot ID: Q14330
  ENSP ID: ENSP00000343428
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILGALTVFYPSIALWLLAFISADRYMAIVQPKYAKELKNTCKAVLACVGVWIMTLTTTTPLLLLYKDPDKDSTPATCLKISDIIYLKAVNVLNLTRLTFFFLIPLFIMIGCYLVIIHNLLHGRTSKLKPKVKEKSIRIIITLLVQVLVCFMPFHICFAFLMLGTGENSYNPWGAFTTFLMNLSTCLDVILYYIVSKQFQARVISVMLYRNYLRSMRRKSFRSGSLRSLSNINSEML

SEQ ID NO: 33522 - protein, 331 aa, Homo sapiens; identical to SEQ ID NO: 33521
  Payload ID: 6590
  Gene Symbol: GPR18
  Gene Name: G protein-coupled receptor 18
  Uniprot ID: Q14330
  ENSP ID: ENSP00000380610

SEQ ID NO: 33523 - protein, 331 aa, Homo sapiens; identical to SEQ ID NO: 33521
  Payload ID: 6590
  Gene Symbol: GPR18
  Gene Name: G protein-coupled receptor 18
  Uniprot ID: Q14330
  ENSP ID: ENSP00000380613

SEQ ID NO: 33524 - protein, 98 aa, Homo sapiens
  Payload ID: 6590
  Gene Symbol: GPR18
  Gene Name: G protein-coupled receptor 18
  ENSP ID: ENSP00000401611
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILG

SEQ ID NO: 33525 - protein, 440 aa, Homo sapiens
  Payload ID: 6591
  Gene Symbol: GPR180
  Gene Name: G protein-coupled receptor 180
  Uniprot ID: Q86V85
  ENSP ID: ENSP00000366157
MGGLRLLAVALTCCWWPQGSQGKTLRGSFSSTAAQDAQGQRIGHFEFHGDHALLCVRINNIAVAVGKEAKLYLFQAQEWLKLQQSSHGYSCSEKLSKAQLTMTMNQTEHNLTVSQIPSPQTWHVFYADKYTCQDDKENSQVEDIPFEMVLLNPDAEGNPFDHFSAGESGLHEFFFLLVLVYFVIACIYAQSLWQAIKKGGPMHMILKVLTTALLLQAGSALANYIHFSSYSKDGIGVPFMGSLAEFFDIASQIQMLYLLLSLCMGWTIVRMKKSQSRPLQWDSTPASTGIAVFIVMTQSVLLLWEQFEDISHHSYHSHHNLAGILLIVLRICLALSLGCGLYQIITVERSTLKREFYITFAKGCILWFLCHPVLACISVIFSDYQRDKVITIGVILCQSVSMVILYRLFLSHSLYWEVSSLSSVTLPLTISSGHKSRPHF

SEQ ID NO: 33526 - protein, 404 aa, Homo sapiens
  Payload ID: 6592
  Gene Symbol: GPR182
  Gene Name: G protein-coupled receptor 182
  Uniprot ID: O15218
  ENSP ID: ENSP00000300098
MSVKPSWGPGPSEGVTAVPTSDLGEIHNWTELLDLFNHTLSECHVELSQSTKRVVLFALYLAMFVVGLVENLLVICVNWRGSGRAGLMNLYILNMAIADLGIVLSLPVWMLEVTLDYTWLWGSFSCRFTHYFYFVNMYSSIFFLVCLSVDRYVTLTSASPSWQRYQHRVRRAMCAGIWVLSAIIPLPEVVHIQLVEGPEPMCLFMAPFETYSTWALAVALSTTILGFLLPFPLITVFNVLTACRLRQPGQPKSRRHCLLLCAYVAVFVMCWLPYHVTLLLLTLHGTHISLHCHLVHLLYFFYDVIDCFSMLHCVINPILYNFLSPHFRGRLLNAVVHYLPKDQTKAGTCASSSSCSTQHSIIITKGDSQPAAAAPHPEPSLSFQAHHLLPNTSPISPTQPLTPS

SEQ ID NO: 33527 - protein, 196 aa, Homo sapiens
  Payload ID: 6592
  Gene Symbol: GPR182
  Gene Name: G protein-coupled receptor 182
  ENSP ID: ENSP00000486086
MISEGGWGWQGWGRSQGLRPAPCSWVSRMVSPPAAIQETQLHFLADTLPSPLSILLPPHKQEELSQSQLLIADLLPASDLGNFQTSRETQSYQKAQPTPISFSPDHRKVSRDVIPGAALGTASSRCWQMLCPSPSVPGTRWGRPQWKLLNSVTGQSSDTVISQFSLAMSFPNFPVPQLRFLNTCSTDETKKSSVNK

SEQ ID NO: 33528 - protein, 55 aa, Homo sapiens
  Payload ID: 6592
  Gene Symbol: GPR182
  Gene Name: G protein-coupled receptor 182
  ENSP ID: ENSP00000487111
  MOD_RES (1)..(1): Any amino acid
XSSSSCSTQHSIIITKGDSQPAAAAPHPEPSLSFQAHHLLPNTSPISPTQPLTPS

SEQ ID NO: 33529 - protein, 361 aa, Homo sapiens [sequence omitted]

SEQ ID NO: 33530 - protein, 415 aa, Homo sapiens
  Payload ID: 6594
  Gene Symbol: GPR19
  Gene Name: G protein-coupled receptor 19
  Uniprot ID: Q15760
  ENSP ID: ENSP00000333744
MVFAHRMDNSKPHLIIPTLLVPLQNRSCTETATPLPSQYLMELSEEHSWMSNQTDLHYVLKPGEVATASIFFGILWLFSIFGNSLVCLVIHRSRRTQSTTNYFVVSMACADLLISVASTPFVLLQFTTGRWTLGSATCKVVRYFQYLTPGVQIYVLLSICIDRFYTIVYPLSFKVSREKAKKMIAASWVFDAGFVTPVLFFYGSNWDSHCNYFLPSSWEGTAYTVIHFLVGFVIPSVLIILFYQKVIKYIWRIGTDGRTVRRTMNIVPRTKVKTIKMFLILNLLFLLSWLPFHVAQLWHPHEQDYKKSSLVFTAITWISFSSSASKPTLYSIYNANFRRGMKETFCMSSMKCYRSNAYTITTSSRMAKKNYVGISEIPSMAKTITKDSIYDSFDREAKEKKLAWPINSNPPNTFV

SEQ ID NO: 33531 - protein, 415 aa, Homo sapiens; identical to SEQ ID NO: 33530
  Payload ID: 6594
  Gene Symbol: GPR19
  Gene Name: G protein-coupled receptor 19
  Uniprot ID: Q15760
  ENSP ID: ENSP00000441832

SEQ ID NO: 33532 - protein, 59 aa, Homo sapiens
  Payload ID: 6594
  Gene Symbol: GPR19
  Gene Name: G protein-coupled receptor 19
  ENSP ID: ENSP00000441963
MVFAHRMDNSKPHLIIPTLLVPLQNRSCTETATPLPSQYLMELSEEHSWMSNQTDLHYV

SEQ ID NO: 33533 - protein, 358 aa, Homo sapiens
  Payload ID: 6595
  Gene Symbol: GPR20
  Gene Name: G protein-coupled receptor 20
  Uniprot ID: Q99678
  ENSP ID: ENSP00000366970
MPSVSPAGPSAGAVPNATAVTTVRTNASGLEVPLFHLFARLDEELHGTFPGLWLALMAVHGAIFLAGLVLNGLALYVFCCRTRAKTPSVIYTINLVVTDLLVGLSLPTRFAVYYGARGCLRCAFPHVLGYFLNMHCSILFLTCICVDRYLAIVRPEGSRRCRQPACARAVCAFVWLAAGAVTLSVLGVTGSRPCCRVFALTVLEFLLPLLVISVFTGRIMCALSRPGLLHQGRQRRVRAMQLLLTVLIIFLVCFTPFHARQVAVALWPDMPHHTSLVVYHVAVTLSSLNSCMDPIVYCFVTSGFQATVRGLFGQHGEREPSSGDVVSMHRSSKGSGRHHILSAGPHALTQALANGPEA

SEQ ID NO: 33534 - protein, 358 aa, Homo sapiens; identical to SEQ ID NO: 33533
  Payload ID: 6595
  Gene Symbol: GPR20
  Gene Name: G protein-coupled receptor 20
  Uniprot ID: Q99678
  ENSP ID: ENSP00000479665

SEQ ID NO: 33535 - protein, 349 aa, Homo sapiens
  Payload ID: 6596
  Gene Symbol: GPR21
  Gene Name: G protein-coupled receptor 21
  Uniprot ID: Q99679
  ENSP ID: ENSP00000362746
MNSTLDGNQSSHPFCLLAFGYLETVNFCLLEVLIIVFLTVLIISGNIIVIFVFHCAPLLNHHTTSYFIQTMAYADLFVGVSCVVPSLSLLHHPLPVEESLTCQIFGFVVSVLKSVSMASLACISIDRYIAITKPLTYNTLVTPWRLRLCIFLIWLYSTLVFLPSFFHWGKPGYHGDVFQWCAESWHTDSYFTLFIVMMLYAPAALIVCFTYFNIFRICQQHTKDISERQARFSSQSGETGEVQACPDKRYAMVLFRITSVFYILWLPYIIYFLLESSTGHSNRFASFLTTWLAISNSFCNCVIYSLSNSVFQRGLKRLSGAMCTSCASQTTANDPYTVRSKGPLNGCHI

SEQ ID NO: 33536 - protein, 433 aa, Homo sapiens
  Payload ID: 6597
  Gene Symbol: GPR22
  Gene Name: G protein-coupled receptor 22
  Uniprot ID: Q99680
  ENSP ID: ENSP00000302676
MCFSPILEINMQSESNITVRDDIDDINTNMYQPLSYPLSFQVSLTGFLMLEIVLGLGSNLTVLVLYCMKSNLINSVSNIITMNLHVLDVIICVGCIPLTIVILLLSLESNTALICCFHEACVSFASVSTAINVFAITLDRYDISVKPANRILTMGRAVMLMISIWIFSFFSFLIPFIEVNFFSLQSGNTWENKTLLCVSTNEYYTELGMYYHLLVQIPIFFFTVVVMLITYTKILQALNIRIGTRFSTGQKKKARKKKTISLTTQHEATDMSQSSGGRNVVFGVRTSVSVIIALRRAVKRHRERRERQKRVFRMSLLIISTFLLCWTPISVLNTTILCLGPSDLLVKLRLCFLVMAYGTTIFHPLLYAFTRQKFQKVLKSKMKKRVVSIVEADPLPNNAVIHNSWIDPKRNKKITFEDSEIREKCLVPQVVTD

SEQ ID NO: 33537 - protein, 361 aa, Homo sapiens
  Payload ID: 6598
  Gene Symbol: GPR25
  Gene Name: G protein-coupled receptor 25
  Uniprot ID: O00155
  ENSP ID: ENSP00000301917
MAPTEPWSPSPGSAPWDYSGLDGLEELELCPAGDLPYGYVYIPALYLAAFAVGLLGNAFVVWLLAGRRGPRRLVDTFVLHLAAADLGFVLTLPLWAAAAALGGRWPFGDGLCKLSSFALAGTRCAGALLLAGMSVDRYLAVVKLLEARPLRTPRCALASCCGVWAVALLAGLPSLVYRGLQPLPGGQDSQCGEEPSHAFQGLSLLLLLLTFVLPLVVTLFCYCRISRRLRRPPHVGRARRNSLRIIFAIESTFVGSWLPFSALRAVFHLARLGALPLPCPLLLALRWGLTIATCLAFVNSCANPLIYLLLDRSFRARALDGACGRTGRLARRISSASSLSRDDSSVFRCRAQAANTASASW

SEQ ID NO: 33538 - protein, 337 aa, Homo sapiens
  Payload ID: 6599
  Gene Symbol: GPR26
  Gene Name: G protein-coupled receptor 26
  Uniprot ID: Q8NDV2
  ENSP ID: ENSP00000284674
MNSWDAGLAGLLVGTMGVSLLSNALVLLCLLHSADIRRQAPALFTLNLTCGNLLCTVVNMPLTLAGVVAQRQPAGDRLCRLAAFLDTFLAANSMLSMAALSIDRWVAVVFPLSYRAKMRLRDAALMVAYTWLHALTFPAAALALSWLGFHQLYASCTLCSRRPDERLRFAVFTGAFHALSFLLSFVVLCCTYLKVLKVARFHCKRIDVITMQTLVLLVDLHPSVRERCLEEQKRRRQRATKKISTFIGTFLVCFAPYVITRLVELFSTVPIGSHWGVLSKCLAYSKAASDPFVYSLLRHQYRKSCKEILNRLLHRRSIHSSGLTGDSHSQNILPVSE

SEQ ID NO: 33539 - protein, 375 aa, Homo sapiens
  Payload ID: 6600
  Gene Symbol: GPR27
  Gene Name: G protein-coupled receptor 27
  Uniprot ID: Q9NS67
  ENSP ID: ENSP00000303149
MANASEPGGSGGGEAAALGLKLATLSLLLCVSLAGNVLFALLIVRERSLHRAPYYLLLDLCLADGLRALACLPAVMLAARRAAAAAGAPPGALGCKLLAFLAALFCFHAAFLLLGVGVTRYLAIAHHRFYAERLAGWPCAAMLVCAAWALALAAAFPPVLDGGGDDEDAPCALEQRPDGAPGALGFLLLLAVVVGATHLVYLRLLFFIHDRRKMRPARLVPAVSHDWTFHGPGATGQAAANWTAGFGRGPTPPALVGIRPAGPGRGARRLLVLEEFKTEKRLCKMFYAVTLLFLLLWGPYVVASYLRVLVRPGAVPQAYLTASVWLTFAQAGINPVVCFLFNRELRDCFRAQFPCCQSPRTTQATHPCDLKGIGL

SEQ ID NO: 33540 - protein, 330 aa, Homo sapiens
  Payload ID: 6601
  Gene Symbol: GPR3
  Gene Name: G protein-coupled receptor 3
  Uniprot ID: P46089
  ENSP ID: ENSP00000363136
MMWGAGSPLAWLSAGSGNVNVSSVGPAEGPTGPAAPLPSPKAWDVVLCISGTLVSCENALVVAIIVGTPAFRAPMFLLVGSLAVADLLAGLGLVLHFAAVFCIGSAEMSLVLVGVLAMAFTASIGSLLAITVDRYLSLYNALTYYSETTVTRTYVMLALVWGGALGLGLLPVLAWNCLDGLTTCGVVYPLSKNHLVVLAIAFFMVFGIMLQLYAQICRIVCRHAQQIALQRHLLPASHYVATRKGIATLAVVLGAFAACWLPFTVYCLLGDAHSPPLYTYLTLLPATYNSMINPIIYAFRNQDVQKVLWAVCCCCSSSKIPFRSRSPSDV

SEQ ID NO: 33541 - protein, 319 aa, Homo sapiens
  Payload ID: 6602
  Gene Symbol: GPR31
  Gene Name: G protein-coupled receptor 31
  Uniprot ID: O00270
  ENSP ID: ENSP00000355799
MPFPNCSAPSTVVATAVGVLLGLECGLGLLGNAVALWTFLFRVRVWKPYAVYLLNLALADLLLAACLPFLAAFYLSLQAWHLGRVGCWALHFLLDLSRSVGMAFLAAVALDRYLRVVHPRLKVNLLSPQAALGVSGLVWLLMVALTCPGLLISEAAQNSTRCHSFYSRADGSFSIIWQEALSCLQFVLPFGLIVFCNAGIIRALQKRLREPEKQPKLQRAQALVTLVVVLFALCFLPCFLARVLMHIFQNLGSCRALCAVAHTSDVTGSLTYLHSVLNPVVYCFSSPTFRSSYRRVFHTLRGKGQAAEPPDFNPRDSYS

SEQ ID NO: 33542 - protein, 356 aa, Homo sapiens
  Payload ID: 6603
  Gene Symbol: GPR32
  Gene Name: G protein-coupled receptor 32
  Uniprot ID: O75388
  ENSP ID: ENSP00000270590
MNGVSEGTRGCSDRQPGVLTRDRSCSRKMNSSGCLSEEVGSLRPLTVVILSASIVVGVLGNGLVLWMTVFRMARTVSTVCFFHLALADFMLSLSLPIAMYYIVSRQWLLGEWACKLYITFVFLSYFASNCLLVFISVDRCISVLYPVWALNHRTVQRASWLAFGVWLLAAALCSAHLKFRTTRKWNGCTHCYLAFNSDNETAQIWIEGVVEGHIIGTIGHFLLGFLGPLAIIGTCAHLIRAKLLREGWVHANRPKRLLLVLVSAFFIFWSPFNVVLLVHLWRRVMLKEIYHPRMLLILQASFALGCVNSSLNPFLYVFVGRDFQEKFFQSLTSALARAFGEEEFLSSCPRGNAPRE

SEQ ID NO: 33543 - protein, 333 aa, Homo sapiens
  Payload ID: 6604
  Gene Symbol: GPR33
  Gene Name: G protein-coupled receptor 33 (gene/pseudogene)
  Uniprot ID: Q49SQ1
  ENSP ID: ENSP00000421557
MDLINSTDYLINASTLVRNSTQFLAPASKMIIALSLYISSIIGTITNGLYLWVLRFKMKQTVNTLLFFHLILSYFISTMILPFMATSQLQDNHWNFGTALCKVFNGTLSLGMFTSVFFLSAIGLDRYLLTLHPVWSQQHRTPRWASSIVLGVWISAAALSIPYLIFRETHHDRKGKVTCQNNYAVSTNWESKEMQASRQWIHVACFISRFLLGFLLPFFIIIFCYERVASKVKERSLFKSSKPFKVMMTAIISFFVCWMPYHIHQGLLLTTNQSLLLELTLILTVLTTSFNTIFSPTLYLFVGENFKKVFKKSILALFESTFSEDSSVERTQT

SEQ ID NO: 33544 - protein, 381 aa, Homo sapiens
  Payload ID: 6605
  Gene Symbol: GPR34
  Gene Name: G protein-coupled receptor 34
  Uniprot ID: Q9UPC5
  ENSP ID: ENSP00000367378
MRSHTITMTTTSVSSWPYSSHRMRFITNHSDQPPQNFSATPNVTTCPMDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 33545 - protein, 381 aa, Homo sapiens; identical to SEQ ID NO: 33544
  Payload ID: 6605
  Gene Symbol: GPR34
  Gene Name: G protein-coupled receptor 34
  Uniprot ID: Q9UPC5
  ENSP ID: ENSP00000367384

SEQ ID NO: 33546 - protein, 334 aa, Homo sapiens
  Payload ID: 6605
  Gene Symbol: GPR34
  Gene Name: G protein-coupled receptor 34
  ENSP ID: ENSP00000480296
MDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 33547 - protein, 309 aa, Homo sapiens
  Payload ID: 6606
  Gene Symbol: GPR35
  Gene Name: G protein-coupled receptor 35
  Uniprot ID: Q9HC97
  ENSP ID: ENSP00000322731
MNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMAFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPSAKAHKSQDSLCVTLA

SEQ ID NO: 33548 - protein, 309 aa, Homo sapiens; identical to SEQ ID NO: 33547
  Payload ID: 6606
  Gene Symbol: GPR35
  Gene Name: G protein-coupled receptor 35
  Uniprot ID: Q9HC97
  ENSP ID: ENSP00000384263

SEQ ID NO: 33549 - protein, 309 aa, Homo sapiens; identical to SEQ ID NO: 33547
  Payload ID: 6606
  Gene Symbol: GPR35
  Gene Name: G protein-coupled receptor 35
  Uniprot ID: Q9HC97
  ENSP ID: ENSP00000385140

SEQ ID NO: 33550 - protein, 340 aa, Homo sapiens
  Payload ID: 6606
  Gene Symbol: GPR35
  Gene Name: G protein-coupled receptor 35
  Uniprot ID: Q9HC97
  ENSP ID: ENSP00000411788
MLSGSRAVPTPHRGSEELLKYMLHSPCVSLTMNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMAFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPSAKAHKSQDSLCVTLA

SEQ ID NO: 33551 - protein, 309 aa, Homo sapiens; identical to SEQ ID NO: 33547
  Payload ID: 6606
  Gene Symbol: GPR35
  Gene Name: G protein-coupled receptor 35
  Uniprot ID: Q9HC97
  ENSP ID: ENSP00000415890

SEQ ID NO: 33552 - protein, 613 aa, Homo sapiens
  Payload ID: 6607
  Gene Symbol: GPR37
  Gene Name: G protein-coupled receptor 37 (endothelin receptor type B-like)
  Uniprot ID: O15354
  ENSP ID: ENSP00000306449
MRAPGALLARMSRLLLLLLLKVSASSALGVAPASRNETCLGESCAPTVIQRRGRDAWGPGNSARDVLRARAPREEQGAAFLAGPSWDLPAAPGRDPAAGRGAEASAAGPPGPPTRPPGPWRWKGARGQEPSETLGRGNPTALQLFLQISEEEEKGPRGAGISGRSQEQSVKTVPGASDLFYWPRRAGKLQGSHHKPLSKTANGLAGHEGWTIALPGRALAQNGSLGEGIHEPGGPRRGNSTNRRVRLKNPFYPLTQESYGAYAVMCLSVVIFGTGIIGNLAVMCIVCHNYYMRSISNSLLANLAFWDFLIIFFCLPLVIFHELTKKWLLEDFSCKIVPYIEVASLGVTTFTLCALCIDRFRAATNVQMYYEMIENCSSTTAKLAVIWVGALLLALPEVVLRQLSKEDLGFSGRAPAERCIIKISPDLPDTIYVLALTYDSARLWWYFGCYFCLPTLFTITCSLVTARKIRKAEKACTRGNKRQIQLESQMNCTVVALTILYGFCIIPENICNIVTAYMATGVSQQTMDLLNIISQFLLFFKSCVTPVLLFCLCKPFSRAFMECCCCCCEECIQKSSTVTSDDNDNEYTTELELSPFSTIRREMSTFASVGTHC

SEQ ID NO: 33553 - protein, 481 aa, Homo sapiens
  Payload ID: 6608
  Gene Symbol: GPR37L1
  Gene Name: G protein-coupled receptor 37 like 1
  Uniprot ID: O60883
  ENSP ID: ENSP00000356251
MRWLWPLAVSLAVILAVGLSRVSGGAPLHLGRHRAETQEQQSRSKRGTEDEEAKGVQQYVPEEWAEYPRPIHPAGLQPTKPLVATSPNPGKDGGTPDSGQELRGNLTGAPGQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 33554 - protein, 453 aa, Homo sapiens
  Payload ID: 6609
  Gene Symbol: GPR39
  Gene Name: G protein-coupled receptor 39
  Uniprot ID: O43194
  ENSP ID: ENSP00000327417
MASPSLPGSDCSQIIDHSHVPEFEVATWIKITLILVYLIIFVMGLLGNSATIRVTQVLQKKGYLQKEVTDHMVSLACSDILVFLIGMPMEFYSIIWNPLTTSSYTLSCKLHTFLFEACSYATLLHVLTLSFERYIAICHPFRYKAVSGPCQVKLLIGFVWVTSALVALPLLFAMGTEYPLVNVPSHRGLTCNRSSTRHHEQPETSNMSICTNLSSRWTVFQSSIFGAFVVYLVVLLSVAFMCWNMMQVLMKSQKGSLAGGTRPPQLRKSESEESRTARRQTIIFLRLIVVTLAVCWMPNQIRRIMAAAKPKHDWTRSYFRAYMILLPFSETFFYLSSVINPLLYTVSSQQFRRVFVQVLCCRLSLQHANHEKRLRVHAHSTTDSARFVQRPLLFASRRQSSARRTEKIFLSTFQSEAEPQSKSQSLSLESLEPNSGAKPANSAAENGFQEHEV

SEQ ID NO: 33555 - protein, 300 aa, Homo sapiens
  Payload ID: 6609
  Gene Symbol: GPR39
  Gene Name: G protein-coupled receptor 39
  ENSP ID: ENSP00000477972
MASPSLPGSDCSQIIDHSHVPEFEVATWIKITLILVYLIIFVMGLLGNSATIRVTQVLQKKGYLQKEVTDHMVSLACSDILVFLIGMPMEFYSIIWNPLTTSSYTLSCKLHTFLFEACSYATLLHVLTLSFERYIAICHPFRYKAVSGPCQVKLLIGFVWVTSALVALPLLFAMGTEYPLVNVPSHRGLTCNRSSTRHHEQPETSNMSICTNLSSRWTVFQSSIFGAFVVYLVVLLSVAFMCWNMMQVLMKSQKGSLAGGTRPPQLRKSESEESRTARRQTIIFLRLGFLPLWVCSLPDQ

SEQ ID NO: 33556 - protein, 362 aa, Homo sapiens
  Payload ID: 6610
  Gene Symbol: GPR4
  Gene Name: G protein-coupled receptor 4
  Uniprot ID: P46093
  ENSP ID: ENSP00000319744
MGNHTWEGCHVDSRVDHLFPPSLYIFVIGVGLPTNCLALWAAYRQVQQRNELGVYLMNLSIADLLYICTLPLWVDYFLHHDNWIHGPGSCKLFGFIFYTNIYISIAFLCCISVDRYLAVAHPLRFARLRRVKTAVAVSSVVWATELGANSAPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAIYLGRPWDCGFEERVFSAYHSSLAFTSLNCVADPILYCLVNEGARSDVAKALHNLLRFLASDKPQEMANASLTLETPLTSKRNSTAKAMTGSWAATPPSQGDQVQLKMLPPAQ

SEQ ID NO: 33557 - protein, 346 aa, Homo sapiens
  Payload ID: 6611
  Gene Symbol: GPR42
  Gene Name: G protein-coupled receptor 42 (gene/pseudogene)
  Uniprot ID: O15529
  ENSP ID: ENSP00000410925
MDTGPDQSYFSGNHWFVFSVYLLTFLVGLPLNLLALVVFVGKLRCRPVAVDVLLLNLTASDLLLLLFLPFRMVEAANGMHWPLPFILCPLSGFIFFTTIYLTALFLAAVSIERFLSVAHPLWYKTRPRLGQAGLVSVACWLLASAHCSVVYVIEFSGDISHSQGTNGTCYLEFWKDQLAILLPVRLEMAVVLFVVPLIITSYCYSRLVWILGRGGSHRRQRRVAGLVAATLLNFLVCFGPYNVSHVVGYICGESPVWRIYVTLLSTLNSCVDPFVYYFSSSGFQADFHELLRRLCGLWGQWQQESSMELKEQKGGEEQRADRPAERKTSEHSQGCGTGGQVACAEN

SEQ ID NO: 33558 - protein, 346 aa, Homo sapiens; identical to SEQ ID NO: 33557
  Payload ID: 6611
  Gene Symbol: GPR42
  Gene Name: G protein-coupled receptor 42 (gene/pseudogene)
  Uniprot ID: O15529
  ENSP ID: ENSP00000473212

SEQ ID NO: 33559 - protein, 372 aa, Homo sapiens
  Payload ID: 6612
  Gene Symbol: GPR45
  Gene Name: G protein-coupled receptor 45
  Uniprot ID: Q9Y5Y3
  ENSP ID: ENSP00000258456
MACNSTSLEAYTYLLLNTSNASDSGSTQLPAPLRISLAIVMLLMTVVGFLGNTVVCIIVYQRPAMRSAINLLLATLAFSDIMLSLCCMPFTAVTLITVRWHFGDHFCRLSATLYWFFVLEGVAILLIISVDRFLIIVQRQDKLNPRRAKVIIAVSWVLSFCIAGPSLTGWTLVEVPARAPQCVLGYTELPADRAYVVTLVVAVFFAPFGVMLCAYMCILNTVRKNAVRVHNQSDSLDLRQLTRAGLRRLQRQQQVSVDLSFKTKAFTTILILFVGFSLCWLPHSVYSLLSVFSQRFYCGSSFYATSTCVLWLSYLKSVFNPIVYCWRIKKFREACIELLPQTFQILPKVPERIRRRIQPSTVYVCNENQSAV

SEQ ID NO: 33560 - protein, 617 aa, Homo sapiens
  Payload ID: 6613
  Gene Symbol: GPR50
  Gene Name: G protein-coupled receptor 50
  Uniprot ID: Q13585
  ENSP ID: ENSP00000218316
MGPTLAVPTPYGCIGCKLPQPEYPPALIIFMFCAMVITIVVDLIGNSMVILAVTKNKKLRNSGNIFVVSLSVADMLVAIYPYPLMLHAMSIGGWDLSQLQCQMVGFITGLSVVGSIFNIVAIAINRYCYICHSLQYERIFSVRNTCIYLVITWIMTVLAVLPNMYIGTIEYDPRTYTCIFNYLNNPVFTVTIVCIHFVLPLLIVGFCYVRIWTKVLAARDPAGQNPDNQLAEVRNFLTMFVIFLLFAVCWCPINVLTVLVAVSPKEMAGKIPNWLYLAAYFIAYFNSCLNAVIYGLLNENFRREYWTIFHAMRHPIIFFSGLISDIREMQEARTLARARAHARDQAREQDRAHACPAVEETPMNVRNVPLPGDAAAGHPDRASGHPKPHSRSSSAYRKSASTHHKSVFSHSKAASGHLKPVSGHSKPASGHPKSATVYPKPASVHFKADSVHFKGDSVHFKPDSVHFKPASSNPKPITGHHVSAGSHSKSAFSAATSHPKPTTGHIKPATSHAEPTTADYPKPATTSHPKPTAADNPELSASHCPEIPAIAHPVSDDSDLPESASSPAAGPTKPAASQLESDTIADLPDPTVVTTSTNDYHDVVVIDVEDDPDEMAV

SEQ ID NO: 33561 - protein, 615 aa, Homo sapiens
  Payload ID: 6613
  Gene Symbol: GPR50
  Gene Name: G protein-coupled receptor 50
  ENSP ID: ENSP00000484496
MGPTLAVPTPYGCIGCKLPQPEYPPALIIFMFCAMVITIVVDLIGNSMVILAVTKNKKLRNSGNIFVVSLSVADMLVAIYPYPLMLHAMSIGGWDLSQLQCQMVGFITGLSVVGSIFNIVAIAINRYCYICHSLQYERIFSVRNTCIYLVITWIMTVLAVLPNMYIGTIEYDPRTYTCIFNYLNNPVFTVTIVCIHFVLPLLIVGFCYVRIWTKVLAARDPAGQNPDNQLAEVRNFLTMFVIFLLFAVCWCPINVLTVLVAVSPKEMAGKIPNWLYLAAYFIAYFNSCLNAVIYGLLNENFRREYWTIFHAMRHPIIFFSGLISDIREMQEARTLARARAHARDQAREQDRAHACPAVEETPMNVRNVPLPGDAAAGHPDRASGHPKPHSRSSSAYRKSASTHHKSVFSHSKAASGHLKPVSGHSKPASGHPKSATVYPKPASVHFKADSVHFKGDSVHFKPDSVHFKPASSNPKPITGHHVSAGSHSKSAFSAATSHPKPTTPHQASYQAEPTTADYPKPATTSHPKPTAADNPELSASHCPEIPAIAHPVSDDSDLPESASSPAAGPTKPAASQLESDTIADLPDPTVVTTSTNDYHDVVVIDVEDDPDEMAV

SEQ ID NO: 33562 - protein, 361 aa, Homo sapiens
  Payload ID: 6614
  Gene Symbol: GPR52
  Gene Name: G protein-coupled receptor 52
  Uniprot ID: Q9Y2T5
  ENSP ID: ENSP00000356658
MNESRWTEWRILNMSSGIVNVSERHSCPLGFGHYSVVDVCIFETVVIVLLTFLIIAGNLTVIFVFHCAPLLHHYTTSYFIQTMAYADLFVGVSCLVPTLSLLHYSTGVHESLTCQVFGYIISVLKSVSMACLACISVDRYLAITKPLSYNQLVTPCRLRICIILIWIYSCLIFLPSFFGWGKPGYHGDIFEWCATSWLTSAYFTGFIVCLLYAPAAFVVCFTYFHIFKICRQHTKEINDRRARFPSHEVDSSRETGHSPDRRYAMVLFRITSVFYMLWLPYIIYFLLESSRVLDNPTLSFLTTWLAISNSFCNCVIYSLSNSVFRLGLRRLSETMCTSCMCVKDQEAQEPKPRKRANSCSI

SEQ ID NO: 33563 - protein, 319 aa, Homo sapiens
  Payload ID: 6615
  Gene Symbol: GPR55
  Gene Name: G protein-coupled receptor 55
  Uniprot ID: Q9Y2T6
  ENSP ID: ENSP00000375893
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHLRSPRKIFGICCTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPVHLGFFLQFLVRNSFIVECRAKQSISFFLQLSMCFSNVNCCLDVFCYYFVIKEFRMNIRAHRPSRVQLVLQDTTISRG

SEQ ID NO: 33564 - protein, 319 aa, Homo sapiens; identical to SEQ ID NO: 33563
  Payload ID: 6615
  Gene Symbol: GPR55
  Gene Name: G protein-coupled receptor 55
  Uniprot ID: Q9Y2T6
  ENSP ID: ENSP00000375894

SEQ ID NO: 33565 - protein, 319 aa, Homo sapiens; identical to SEQ ID NO: 33563
  Payload ID: 6615
  Gene Symbol: GPR55
  Gene Name: G protein-coupled receptor 55
  Uniprot ID: Q9Y2T6
  ENSP ID: ENSP00000410267

SEQ ID NO: 33566 - protein, 242 aa, Homo sapiens
  Payload ID: 6615
  Gene Symbol: GPR55
  Gene Name: G protein-coupled receptor 55
  ENSP ID: ENSP00000412768
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHLRSPRKIFGICCTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPV

SEQ ID NO: 33567 - protein, 319 aa, Homo sapiens; identical to SEQ ID NO: 33563
  Payload ID: 6615
  Gene Symbol: GPR55
  Gene Name: G protein-coupled receptor 55
  Uniprot ID: Q9Y2T6
  ENSP ID: ENSP00000482381

SEQ ID NO: 33568 - protein, 362 aa, Homo sapiens
  Payload ID: 6616
  Gene Symbol: GPR6
  Gene Name: G protein-coupled receptor 6
  Uniprot ID: P46095
  ENSP ID: ENSP00000275169
MNASAASLNDSQVVVVAAEGAAAAATAAGGPDTGEWGPPAAAALGAGGGANGSLELSSQLSAGPPGLLLPAVNPWDVLLCVSGTVIAGENALVVALIASTPALRTPMFVLVGSLATADLLAGCGLILHFVFQYLVPSETVSLLTVGFLVASFAASVSSLLAITVDRYLSLYNALTYYSRRTLLGVHLLLAATWTVSLGLGLLPVLGWNCLAERAACSVVRPLARSHVALLSAAFFMVFGIMLHLYVRICQVVWRHAHQIALQQHCLAPPHLAATRKGVGTLAVVLGTFGASWLPFAIYCVVGSHEDPAVYTYATLLPATYNSMINPIIYAFRNQEIQRALWLLLCGCFQSKVPFRSRSPSEV

SEQ ID NO: 33569 - protein, 377 aa, Homo sapiens
  Payload ID: 6616
  Gene Symbol: GPR6
  Gene Name: G protein-coupled receptor 6
  Uniprot ID: P46095
  ENSP ID: ENSP00000406986
MTLLAWCTRGANPAAMNASAASLNDSQVVVVAAEGAAAAATAAGGPDTGEWGPPAAAALGAGGGANGSLELSSQLSAGPPGLLLPAVNPWDVLLCVSGTVIAGENALVVALIASTPALRTPMFVLVGSLATADLLAGCGLILHFVFQYLVPSETVSLLTVGFLVASFAASVSSLLAITVDRYLSLYNALTYYSRRTLLGVHLLLAATWTVSLGLGLLPVLGWNCLAERAACSVVRPLARSHVALLSAAFFMVFGIMLHLYVRICQVVWRHAHQIALQQHCLAPPHLAATRKGVGTLAVVLGTFGASWLPFAIYCVVGSHEDPAVYTYATLLPATYNSMINPIIYAFRNQEIQRALWLLLCGCFQSKVPFRSRSPSEV

SEQ ID NO: 33570 - protein, 451 aa, Homo sapiens
  Payload ID: 6617
  Gene Symbol: GPR61
  Gene Name: G protein-coupled receptor 61
  Uniprot ID: Q9BZJ8
  ENSP ID: ENSP00000385422
MESSPIPQSSGNSSTLGRVPQTPGPSTASGVPEVGLRDVASESVALFFMLLLDLTAVAGNAAVMAVIAKTPALRKFVFVFHLCLVDLLAALTLMPLAMLSSSALFDHALFGEVACRLYLFLSVCFVSLAILSVSAINVERYYYVVHPMRYEVRMTLGLVASVLVGVWVKALAMASVPVLGRVSWEEGAPSVPPGCSLQWSHSAYCQLFVVVFAVLYFLLPLLLILVVYCSMFRVARVAAMQHGPLPTWMETPRQRSESLSSRSTMVTSSGAPQTTPHRTFGGGKAAVVLLAVGGQFLLCWLPYFSFHLYVALSAQPISTGQVESVVTWIGYFCFTSNPFFYGCLNRQIRGELSKQFVCFFKPAPEEELRLPSREGSIEENFLQFLQGTGCPSESWVSRPLPSPKQEPPAVDFRIPGQIAEETSEFLEQQLTSDIIMSDSYLRPAASPRLES

SEQ ID NO: 33571 - protein, 451 aa, Homo sapiens; identical to SEQ ID NO: 33570
  Payload ID: 6617
  Gene Symbol: GPR61
  Gene Name: G protein-coupled receptor 61
  Uniprot ID: Q9BZJ8
  ENSP ID: ENSP00000432456

SEQ ID NO: 33572 - protein, 451 aa, Homo sapiens; identical to SEQ ID NO: 33570
  Payload ID: 6617
  Gene Symbol: GPR61
  Gene Name: G protein-coupled receptor 61
  Uniprot ID: Q9BZJ8
  ENSP ID: ENSP00000433661

SEQ ID NO: 33573 - protein, 451 aa, Homo sapiens; identical to SEQ ID NO: 33570
  Payload ID: 6617
  Gene Symbol: GPR61
  Gene Name: G protein-coupled receptor 61
  Uniprot ID: Q9BZJ8
  ENSP ID: ENSP00000484035

SEQ ID NO: 33574 - protein, 451 aa, Homo sapiens; identical to SEQ ID NO: 33570
  Payload ID: 6617
  Gene Symbol: GPR61
  Gene Name: G protein-coupled receptor 61
  Uniprot ID: Q9BZJ8
  ENSP ID: ENSP00000484797

SEQ ID NO: 33575 - protein, 368 aa, Homo sapiens
  Payload ID: 6618
  Gene Symbol: GPR62
  Gene Name: G protein-coupled receptor 62
  Uniprot ID: Q9BZJ7
  ENSP ID: ENSP00000319250
MANSTGLNASEVAGSLGLILAAVVEVGALLGNGALLVVVLRTPGLRDALYLAHLCVVDLLAAASIMPLGLLAAPPPGLGRVRLGPAPCRAARFLSAALLPACTLGVAALGLARYRLIVHPLRPGSRPPPVLVLTAVWAAAGLLGALSLLGTPPAPPPAPARCSVLAGGLGPFRPLWALLAFALPALLLLGAYGGIFVVARRAALRPPRPARGSRLHSDSLDSRLSILPPLRPRLPGGKAALAPALAVGQFAACWLPYGCACLAPAARAAEAEAAVTWVAYSAFAAHPFLYGLLQRPVRLALGRLSRRALPGPVRACTPQAWHPRALLQCLQRPPEGPAVGPSEAPEQTPELAGGRSPAYQGPPESSLS

SEQ ID NO: 33576 - protein, 419 aa, Homo sapiens
  Payload ID: 6619
  Gene Symbol: GPR63
  Gene Name: G protein-coupled receptor 63
  Uniprot ID: Q9BZJ6
  ENSP ID: ENSP00000229955
MVFSAVLTAFHTGTSNTTFVVYENTYMNITLPPPFQHPDLSPLLRYSFETMAPTGLSSLTVNSTAVPTTPAAFKSLNLPLQITLSAIMIFILFVSFLGNLVVCLMVYQKAAMRSAINILLASLAFADMLLAVLNMPFALVTILTTRWIFGKFFCRVSAMFFWLFVIEGVAILLIISIDRFLIIVQRQDKLNPYRAKVLIAVSWATSFCVAFPLAVGNPDLQIPSRAPQCVFGYTTNPGYQAYVILISLISFFIPFLVILYSFMGILNTLRHNALRIHSYPEGICLSQASKLGLMSLQRPFQMSIDMGFKTRAFTTILILFAVFIVCWAPFTTYSLVATFSKHFYYQHNFFEISTWLLWLCYLKSALNPLIYYWRIKKFHDACLDMMPKSFKFLPQLPGHTKRRIRPSAVYVCGEHRTVV

SEQ ID NO: 33577 - protein, 337 aa, Homo sapiens
  Payload ID: 6620
  Gene Symbol: GPR65
  Gene Name: G protein-coupled receptor 65
  Uniprot ID: Q8IYL9
  ENSP ID: ENSP00000267549
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 33578 - protein, 338 aa, Homo sapiens
  Payload ID: 6621
  Gene Symbol: GPR68
  Gene Name: G protein-coupled receptor 68
  ENSP ID: ENSP00000432740
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEP

SEQ ID NO: 33579 - protein, 365 aa, Homo sapiens
  Payload ID: 6621
  Gene Symbol: GPR68
  Gene Name: G protein-coupled receptor 68
  Uniprot ID: Q15743
  ENSP ID: ENSP00000434045
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEPELLTKLHPAFQTPNSPGSGGFPTGRLA

SEQ ID NO: 33580 - protein, 365 aa, Homo sapiens; identical to SEQ ID NO: 33579
  Payload ID: 6621
  Gene Symbol: GPR68
  Gene Name: G protein-coupled receptor 68
  Uniprot ID: Q15743
  ENSP ID: ENSP00000440797

SEQ ID NO: 33581 - protein, 540 aa, Homo sapiens
  Payload ID: 6622
  Gene Symbol: GPR75
  Gene Name: G protein-coupled receptor 75
  Uniprot ID: O95800
  ENSP ID: ENSP00000378195
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNAQVRKCPPVITVDASRPQPFMGVPVQGGGDPIQCAMPALYRNQNYNKLQHVQTRGYTKSPNQLVTPAASRLQLVSAINLSTAKDSKAVVTCVIIVLSVLVCCLPLGISLVQVVLSSNGSFILYQFELFGFTLIFFKSGLNPFIYSRNSAGLRRKVLWCLQYIGLGFFCCKQKTRLRAMGKGNLEVNRNKSSHHETNSAYMLSPKPQKKFVDQACGPSHSKESMVSPKISAGHQHCGQSSSTPINTRIEPYYSIYNSSPSQEESSPCNLQPVNSFGFANSYIAMHYHTTNDLVQEYDSTSAKQIPVPSV

SEQ ID NO: 33582 - protein, 363 aa, Homo sapiens
  Payload ID: 6623
  Gene Symbol: GPR78
  Gene Name: G protein-coupled receptor 78
  Uniprot ID: Q96P69
  ENSP ID: ENSP00000371927
MGPGEALLAGLLVMVLAVALLSNALVLLCCAYSAELRTRASGVLLVNLSLGHLLLAALDMPFTLLGVMRGRTPSAPGACQVIGFLDTFLASNAALSVAALSADQWLAVGFPLRYAGRLRPRYAGLLLGCAWGQSLAFSGAALGCSWLGYSSAFASCSLRLPPEPERPRFAAFTATLHAVGFVLPLAVLCLTSLQVHRVARRHCQRMDTVTMKALALLADLHPSVRQRCLIQQKRRRHRATRKIGIAIATFLICFAPYVMTRLAELVPFVTVNAQWGILSKCLTYSKAVADPFTYSLLRRPFRQVLAGMVHRLLKRTPRPASTHDSSLDVAGMVHQLLKRTPRPASTHNGSVDTENDSCLQQTH

SEQ ID NO: 33583 - protein, 261 aa, Homo sapiens
  Payload ID: 6623
  Gene Symbol: GPR78
  Gene Name: G protein-coupled receptor 78
  ENSP ID: ENSP00000424326
MGPGEALLAGLLVMVLAVALLSNALVLLCCAYSAELRTRASGVLLVNLSLGHLLLAALDMPFTLLGVMRGRTPSAPGACQVIGFLDTFLASNAALSVAALSADQWLAVGFPLRYAGRLRPRYAGLLLGCAWGQSLAFSGAALGCSWLGYSSAFASCSLRLPPEPERPRFAAFTATLHAVGFVLPLAVLCLTSLQVHRVARRHCQRMDTVTMKALALLADLHPSVRQRCLIQQKRRRHRATRKIGIAIATFLICFAPYVMTR

SEQ ID NO: 33584 - protein, 336 aa, Homo sapiens
  Payload ID: 6624
  Gene Symbol: GPR82
  Gene Name: G protein-coupled receptor 82
  Uniprot ID: Q96P67
  ENSP ID: ENSP00000303549
MNNNTTCIQPSMISSMALPIIYILLCIVGVFGNTLSQWIFLTKIGKKTSTHIYLSHLVTANLLVCSAMPFMSIYFLKGFQWEYQSAQCRVVNFLGTLSMHASMFVSLLILSWIAISRYATLMQKDSSQETTSCYEKIFYGHLLKKFRQPNFARKLCIYIWGVVLGIIIPVTVYYSVIEATEGEESLCYNRQMELGAMISQIAGLIGTTFIGFSFLVVLTSYYSFVSHLRKIRTCTSIMEKDLTYSSVKRHLLVIQILLIVCFLPYSIFKPIFYVLHQRDNCQQLNYLIETKNILTCLASARSSTDPIIFLLLDKTFKKTLYNLFTKSNSAHMQSYG

SEQ ID NO: 33585 - protein, 423 aa, Homo sapiens
  Payload ID: 6625
  Gene Symbol: GPR83
  Gene Name: G protein-coupled receptor 83
  Uniprot ID: Q9NYM4
  ENSP ID: ENSP00000243673
MVPHLLLLCLLPLVRATEPHEGRADEQSAEAALAVPNASHFFSWNNYTFSDWQNFVGRRRYGAESQNPTVKALLIVAYSFIIVFSLFGNVLVCHVIFKNQRMHSATSLFIVNLAVADIMITLLNTPFTLVRFVNSTWIFGKGMCHVSRFAQYCSLHVSALTLTAIAVDRHQVIMHPLKPRISITKGVIYIAVIWTMATFFSLPHAICQKLFTFKYSEDIVRSLCLPDFPEPADLFWKYLDLATFILLYILPLLIISVAYARVAKKLWLCNMIGDVTTEQYFALRRKKKKTIKMLMLVVVLFALCWFPLNCYVLLLSSKVIRTNNALYFAFHWFAMSSTCYNPFIYCWLNENFRIELKALLSMCQRPPKPQEDRPPSPVPSFRVAWTEKNDGQRAPLANNLLPTSQLQSGKTDLSSVEPIVTMS

SEQ ID NO: 33586 - protein, 381 aa, Homo sapiens
  Payload ID: 6625
  Gene Symbol: GPR83
  Gene Name: G protein-coupled receptor 83
  ENSP ID: ENSP00000441550
MVPHLLLLCLLPLVRATEPHEGRADEQSAEAALAVPNASHFFSWNNYTFSDWQNFVGRRRYGAESQNPTVKALLIVAYSFIIVFSLFGNVLVCHVIFKNQRMHSATSLFIVNLAVADIMITLLNTPFTLVIMHPLKPRISITKGVIYIAVIWTMATFFSLPHAICQKLFTFKYSEDIVRSLCLPDFPEPADLFWKYLDLATFILLYILPLLIISVAYARVAKKLWLCNMIGDVTTEQYFALRRKKKKTIKMLMLVVVLFALCWFPLNCYVLLLSSKVIRTNNALYFAFHWFAMSSTCYNPFIYCWLNENFRIELKALLSMCQRPPKPQEDRPPSPVPSFRVAWTEKNDGQRAPLANNLLPTSQLQSGKTDLSSVEPIVTMS

SEQ ID NO: 33587 - protein, 396 aa, Homo sapiens
  Payload ID: 6626
  Gene Symbol: GPR84
  Gene Name: G protein-coupled receptor 84
  Uniprot ID: Q9NQS5
  ENSP ID: ENSP00000267015
MWNSSDANFSCYHESVLGYRYVAVSWGVVVAVTGTVGNVLTLLALAIQPKLRTRFNLLIANLTLADLLYCTLLQPFSVDTYLHLHWRTGATFCRVFGLLLFASNSVSILTLCLIALGRYLLIAHPKLFPQVFSAKGIVLALVSTWVVGVASFAPLWPIYILVPVVCTCSFDRIRGRPYTTILMGIYFVLGLSSVGIFYCLIHRQVKRAAQALDQYKLRQASIHSNHVARTDEAMPGRFQELDSRLASGGPSEGISSEPVSAATTQTLEGDSSEVGDQINSKRAKQMAEKSPPEASAKAQPIKGARRAPDSSSEFGKVTRMCFAVFLCFALSYIPFLLLNILDARVQAPRVVHMLAANLTWLNGCINPVLYAAMNRQFRQAYGSILKRGPRSFHRLH

SEQ ID NO: 33588 - protein, 396 aa, Homo sapiens; identical to SEQ ID NO: 33587
  Payload ID: 6626
  Gene Symbol: GPR84
  Gene Name: G protein-coupled receptor 84
  Uniprot ID: Q9NQS5
  ENSP ID: ENSP00000450310

SEQ ID NO: 33589 - protein, 370 aa, Homo sapiens
  Payload ID: 6627
  Gene Symbol: GPR85
  Gene Name: G protein-coupled receptor 85
  Uniprot ID: P60893
  ENSP ID: ENSP00000297146
MANYSHAADNILQNLSPLTAFLKLTSLGFIIGVSVVGNLLISILLVKDKTLHRAPYYFLLDLCCSDILRSAICFPFVFNSVKNGSTWTYGTLTCKVIAFLGVLSCFHTAFMLFCISVTRYLAIAHHRFYTKRLTFWTCLAVICMVWTLSVAMAFPPVLDVGTYSFIREEDQCTFQHRSFRANDSLGFMLLLALILLATQLVYLKLIFFVHDRRKMKPVQFVAAVSQNWTFHGPGASGQAAANWLAGFGRGPTPPTLLGIRQNANTTGRRRLLVLDEFKMEKRISRMFYIMTFLFLTLWGPYLVACYWRVFARGPVVPGGFLTAAVWMSFAQAGINPFVCIFSNRELRRCFSTTLLYCRKSRLPREPYCVI

SEQ ID NO: 33590 - protein, 370 aa, Homo sapiens; identical to SEQ ID NO: 33589
  Payload ID: 6627
  Gene Symbol: GPR85
  Gene Name: G protein-coupled receptor 85
  Uniprot ID: P60893
  ENSP ID: ENSP00000396763

SEQ ID NO: 33591 - protein, 370 aa, Homo sapiens; identical to SEQ ID NO: 33589
  Payload ID: 6627
  Gene Symbol: GPR85
  Gene Name: G protein-coupled receptor 85
  Uniprot ID: P60893
  ENSP ID: ENSP00000401178

SEQ ID NO: 33592 - protein, 121 aa, Homo sapiens
  Payload ID: 6627
  Gene Symbol: GPR85
  Gene Name: G protein-coupled receptor 85
  ENSP ID: ENSP00000415699
MANYSHAADNILQNLSPLTAFLKLTSLGFIIGVSVVGNLLISILLVKDKTLHRAPYYFLLDLCCSDILRSAICFPFVFNSVKNGSTWTYGTLTCKVIAFLGVLSCFHTAFMLFCISVTRYL

SEQ ID NO: 33593 - protein, 71 aa, Homo sapiens
  Payload ID: 6627
  Gene Symbol: GPR85
  Gene Name: G protein-coupled receptor 85
  ENSP ID: ENSP00000416722
MANYSHAADNILQNLSPLTAFLKLTSLGFIIGVSVVGNLLISILLVKDKTLHRAPYYFLLDLCCSDILRSA

SEQ ID NO: 33594 - protein, 370 aa, Homo sapiens; identical to SEQ ID NO: 33589
  Payload ID: 6627
  Gene Symbol: GPR85
  Gene Name: G protein-coupled receptor 85
  Uniprot ID: P60893
  ENSP ID: ENSP00000476863

SEQ ID NO: 33595 - protein, 358 aa, Homo sapiens
  Payload ID: 6628
  Gene Symbol: GPR87
  Gene Name: G protein-coupled receptor 87
  Uniprot ID: Q9BY21
  ENSP ID: ENSP00000260843
MGFNLTLAKLPNNELHGQESHNSGNRSDGPGKNTTLHNEFDTIVLPVLYLIIFVASILLNGLAVWIFFHIRNKTSFIFYLKNIVVADLIMTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIYFFMCRSFSRRLFKKSNIRTRSESIRSLQSVRRSEVRIYYDYTDV

SEQ ID NO: 33596 - protein, 384 aa, Homo sapiens
  Payload ID: 6629
  Gene Symbol: GPR88
  Gene Name: G protein-coupled receptor 88
  Uniprot ID: Q9GZN0
  ENSP ID: ENSP00000314223
MTNSSSTSTSSTTGGSLLLLCEEEESWAGRRIPVSLLYSGLAIGGTLANGMVIYLVSSFRKLQTTSNAFIVNGCAADLSVCALWMPQEAVLGLLPTGSAEPPADWDGAGGSYRLLRGGLLGLGLTVSLLSHCLVALNRYLLITRAPATYQALYQRRHTAGMLALSWALALGLVLLLPPWAPRPGAAPPRVHYPALLAAAALLAQTALLLHCYLGIVRRVRVSVKRVSVLNFHLLHQLPGCAAAAAAFPGAQHAPGPGGAAHPAQAQPLPPALHPRRAQRRLSGLSVLLLCCVFLLATQPLVWVSLASGFSLPVPWGVQAASWLLCCALSALNPLLYTWRNEEFRRSVRSVLPGVGDAAAAAVAATAVPAVSQAQLGTRAAGQHW

SEQ ID NO: 33597 - protein, 455 aa, Homo sapiens
  Payload ID: 6630
  Gene Symbol: GPR89A
  Gene Name: G protein-coupled receptor 89A
  Uniprot ID: B7ZAQ6
  ENSP ID: ENSP00000319673
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 33598 - protein, 55 aa, Homo sapiens
  Payload ID: 6630
  Gene Symbol: GPR89A
  Gene Name: G protein-coupled receptor 89A
  ENSP ID: ENSP00000432212
MSFLIDSSIMITSQPRLSGDWPAAVRVPTRHPSPEFRSTFGSGPPTSRLRAGAAS

SEQ ID NO: 33599 - protein, 430 aa, Homo sapiens
  Payload ID: 6630
  Gene Symbol: GPR89A
  Gene Name: G protein-coupled receptor 89A
  Uniprot ID: B7ZAQ6
  ENSP ID: ENSP00000432248
MRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 33600 - protein, 229 aa, Homo sapiens
  Payload ID: 6630
  Gene Symbol: GPR89A
  Gene Name: G protein-coupled receptor 89A
  ENSP ID: ENSP00000433482
MSFLIDSSIMITSQIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSESILCPSA

SEQ ID NO: 33601 - protein, 124 aa, Homo sapiens
  Payload ID: 6630
  Gene Symbol: GPR89A
  Gene Name: G protein-coupled receptor 89A
  Uniprot ID: B7ZAQ6
  ENSP ID: ENSP00000434108
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLLSPLSQCINNDCFFPVSYG

SEQ ID NO: 33602 - protein, 430 aa, Homo sapiens; identical to SEQ ID NO: 33599
  Payload ID: 6630
  Gene Symbol: GPR89A
  Gene Name: G protein-coupled receptor 89A
  Uniprot ID: B7ZAQ6
  ENSP ID: ENSP00000434495

SEQ ID NO: 33603 - protein, 124 aa, Homo sapiens; identical to SEQ ID NO: 33601
  Payload ID: 6630
  Gene Symbol: GPR89A
  Gene Name: G protein-coupled receptor 89A
  Uniprot ID: B7ZAQ6
  ENSP ID: ENSP00000436705

SEQ ID NO: 33604 - protein, 455 aa, Homo sapiens; identical to SEQ ID NO: 33597
  Payload ID: 6631
  Gene Symbol: GPR89B
  Gene Name: G protein-coupled receptor 89B
  Uniprot ID: P0CG08
  ENSP ID: ENSP00000358233

SEQ ID NO: 33605 - protein, 216 aa, Homo sapiens
  Payload ID: 6631
  Gene Symbol: GPR89B
  Gene Name: G protein-coupled receptor 89B
  ENSP ID: ENSP00000475253
MSFLIDSSIMITSQIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTT

SEQ ID NO: 33606 - protein, 93 aa, Homo sapiens
  Payload ID: 6631
  Gene Symbol: GPR89B
  Gene Name: G protein-coupled receptor 89B
  ENSP ID: ENSP00000480007
  MOD_RES (1)..(1): Any amino acid
XCPYTYMSYFLRNVTDTDILALERRLLQTMDMIISKKKRMAMARRTMFQKGEVHNKPSGFWGMIKSVTTSASGSETSLSLCAKWITPWHKTIP

SEQ ID NO: 33607 - protein, 128 aa, Homo sapiens
  Payload ID: 6631
  Gene Symbol: GPR89B
  Gene Name: G protein-coupled receptor 89B
  ENSP ID: ENSP00000480018
  MOD_RES (1)..(1): Any amino acid
XLSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSETSLSLCAKWITPWHKTIP

SEQ ID NO: 33608 - protein, 124 aa, Homo sapiens; identical to SEQ ID NO: 33601
  Payload ID: 6631
  Gene Symbol: GPR89B
  Gene Name: G protein-coupled receptor 89B
  ENSP ID: ENSP00000480882

SEQ ID NO: 33609 - protein, 1395 aa, Homo sapiens
  Payload ID: 6632
  Gene Symbol: GPRASP1
  Gene Name: G protein-coupled receptor associated sorting protein 1
  Uniprot ID: Q5JY77
  ENSP ID: ENSP00000355146
MTGAEIESGAQVKPEKKPGEEVVGGAEIENDVPLVVRPKVRTQAQIMPGARPKNKSKVMPGASTKVETSAVGGARPKSKAKAIPVSRFKEEAQMWAQPRFGAERLSKTERNSQTNIIASPLVSTDSVLVAKTKYLSEDRELVNTDTESFPRRKAHYQAGFQPSFRSKEETNMGSWCCPRPTSKQEASPNSDFKWVDKSVSSLFWSGDEVTAKFHPGNRVKDSNRSMHMANQEANTMSRSQTNQELYIASSSGSEDESVKTPWFWARDKTNTWSGPREDPNSRSRFRSKKEVYVESSSGSEHEDHLESWFGAGKEAKFRSKMRAGKEANNRARHRAKREACIDFMPGSIDVIKKESCFWPEENANTFSRPMIKKEARARAMTKEEAKTKARARAKQEARSEEEALIGTWFWATDESSMADEASIESSLQVEDESIIGSWFWTEEEASMGTGASSKSRPRTDGERIGDSLFGAREKTSMKTGAEATSESILAADDEQVIIGSWFWAGEEVNQEAEEETIFGSWFWVIDAASVESGVGVSCESRTRSEEEEVIGPWFWSGEQVDIEAGIGEEARPGAEEETIFGSWFWAENQTYMDCRAETSCDTMQGAEEEEPIIGSWFWTRVEACVEGDVNSKSSLEDKEEAMIPCFGAKEEVSMKHGTGVRCRFMAGAEETNNKSCFWAEKEPCMYPAGGGSWKSRPEEEEDIVNSWFWSRKYTKPEAIIGSWLWATEESNIDGTGEKAKLLTEEETIINSWFWKEDEAISEATDREESRPEAEEGDIIGSWFWAGEEDRLEPAAETREEDRLAAEKEGIVGSWFGAREETIRREAGSCSKSSPKAEEEEVIIGSWFWEEEASPEAVAGVGFESKPGTEEEEITVGSWFWPEEEASIQAGSQAVEEMESETEEETIFGSWFWDGKEVSEEAGPCCVSKPEDDEEMIVESWFWSRDKAIKETGTVATCESKPENEEGAIVGSWFEAEDEVDNRTDNGSNCGSRTLADEDEAIVGSWFWAGDEAHFESNPSPVFRAICRSTCSVEQEPDPSRRPQSWEEVTVQFKPGPWGRVGFPSISPFRFPKEAASLFCEMFGGKPRNMVLSPEGEDQESLLQPDQPSPEFPFQYDPSYRSVQEIREHLRAKESTEPESSSCNCIQCELKIGSEEFEELLLLMEKIRDPFIHEISKIAMGMRSASQFTRDFIRDSGVVSLIETLLNYPSSRVRTSFLENMIRMAPPYPNLNIIQTYICKVCEETLAYSVDSPEQLSGIRMIRHLTTTTDYHTLVANYMSGFLSLLATGNAKTRFHVLKMLLNLSENLFMTKELLSAEAVSEFIGLFNREETNDNIQIVLAIFENIGNNIKKETVFSDDDFNIEPLISAFHKVEKFAKELQGKTDNQNDPEGDQEN

SEQ ID NO: 33610 - protein, 1395 aa, Homo sapiens; identical to SEQ ID NO: 33609
  Payload ID: 6632
  Gene Symbol: GPRASP1
  Gene Name: G protein-coupled receptor associated sorting protein 1
  Uniprot ID: Q5JY77
  ENSP ID: ENSP00000393691

SEQ ID NO: 33611 - protein, 1395 aa, Homo sapiens; identical to SEQ ID NO: 33609
  Payload ID: 6632
  Gene Symbol: GPRASP1
  Gene Name: G protein-coupled receptor associated sorting protein 1
  Uniprot ID: Q5JY77
  ENSP ID: ENSP00000409420

SEQ ID NO: 33612 - protein, 1395 aa, Homo sapiens; identical to SEQ ID NO: 33609
  Payload ID: 6632
  Gene Symbol: GPRASP1
  Gene Name: G protein-coupled receptor associated sorting protein 1
  Uniprot ID: Q5JY77
  ENSP ID: ENSP00000445683

SEQ ID NO: 33613 - protein, 838 aa, Homo sapiens
  Payload ID: 6633
  Gene Symbol: GPRASP2
  Gene Name: G protein-coupled receptor associated sorting protein 2
  Uniprot ID: Q96D09
  ENSP ID: ENSP00000339057
MTGAEIEPSAQAKPEKKAGEEVIAGPERENDVPLVVRPKVRTQATTGARPKTETKSVPAARPKTEAQAMSGARPKTEVQVMGGARPKTEAQGITGARPKTDARAVGGARSKTDAKAIPGARPKDEAQAWAQSEFGTEAVSQAEGVSQTNAVAWPLATAESGSVTKSKGLSMDRELVNVDAETFPGTQGQKGIQPWFGPGEETNMGSWCYSRPRAREEASNESGFWSADETSTASSFWTGEETSVRSWPREESNTRSRHRAKHQTNPRSRPRSKQEAYVDSWSGSEDEASNPFSFWVGENTNNLFRPRVREEANIRSKLRTNREDCFESESEDEFYKQSWVLPGEEANSRFRHRDKEDPNTALKLRAQKDVDSDRVKQEPRFEEEVIIGSWFWAEKEASLEGGASAICESEPGTEEGAIGGSAYWAEEKSSLGAVAREEAKPESEEEAIFGSWFWDRDEACFDLNPCPVYKVSDRFRDAAEELNASSRPQTWDEVTVEFKPGLFHGVGFRSTSPFGIPEEASEMLEAKPKNLELSPEGEEQESLLQPDQPSPEFTFQYDPSYRSVREIREHLRARESAESESWSCSCIQCELKIGSEEFEEFLLLMDKIRDPFIHEISKIAMGMRSASQFTRDFIRDSGVVSLIETLLNYPSSRVRTSFLENMIHMAPPYPNLNMIETFICQVCEETLAHSVDSLEQLTGIRMLRHLTMTIDYHTLIANYMSGFLSLLTTANARTKFHVLKMLLNLSENPAVAKKLFSAKALSIFVGLFNIEETNDNIQIVIKMFQNISNIIKSGKMSLIDDDFSLEPLISAFREFEELAKQLQAQIDNQNDPEVGQQS

SEQ ID NO: 33614 - protein, 838 aa, Homo sapiens; identical to SEQ ID NO: 33613
  Payload ID: 6633
  Gene Symbol: GPRASP2
  Gene Name: G protein-coupled receptor associated sorting protein 2
  Uniprot ID: Q96D09
  ENSP ID: ENSP00000437394

SEQ ID NO: 33615 - protein, 838 aa, Homo sapiens; identical to SEQ ID NO: 33613
  Payload ID: 6633
  Gene Symbol: GPRASP2
  Gene Name: G protein-coupled receptor associated sorting protein 2
  Uniprot ID: Q96D09
  ENSP ID: ENSP00000437872

SEQ ID NO: 33616 - protein, 563 aa, Homo sapiens
  Payload ID: 6634
  Gene Symbol: GRK1
  Gene Name: G protein-coupled receptor kinase 1
  Uniprot ID: Q15835
  ENSP ID: ENSP00000334876
MDFGSLETVVANSAFIAARGSFDGSSSQPSRDKKYLAKLKLPPLSKCESLRDSLSLEFESVCLEQPIGKKLFQQFLQSAEKHLPALELWKDIEDYDTADNDLQPQKAQTILAQYLDPQAKLFCSFLDEGIVAKFKEGPVEIQDGLFQPLLQATLAHLGQAPFQEYLGSLYFLRFLQWKWLEAQPMGEDWFLDFRVLGKGGFGEVSACQMKATGKLYACKKLNKKRLKKRKGYQGAMVEKKILMKVHSRFIVSLAYAFETKADLCLVMTIMNGGDIRYHIYNVNEENPGFPEPRALFYTAQIICGLEHLHQRRIVYRDLKPENVLLDNDGNVRISDLGLAVELLDGQSKTKGYAGTPGFMAPELLQGEEYDFSVDYFALGVTLYEMIAARGPFRARGEKVENKELKHRIISEPVKYPDKFSQASKDFCEALLEKDPEKRLGFRDETCDKLRAHPLFKDLNWRQLEAGMLMPPFIPDSKTVYAKDIQDVGAFSTVKGVAFDKTDTEFFQEFATGNCPIPWQEEMIETGIFGELNVWRSDGQMPDDMKGISGGSSSSSKSGMCLVS

SEQ ID NO: 33617 - protein, 207 aa, Homo sapiens
  Payload ID: 6634
  Gene Symbol: GRK1
  Gene Name: G protein-coupled receptor kinase 1
  ENSP ID: ENSP00000488329
  MOD_RES (1)..(1): Any amino acid
XFMAPELLQGEEYDFSVDYFALGVTLYEMIAARGPFRARGEKVENKELKHRIISEPVKYPDKFSQASKDFCEALLEKDPEKRLGFRDETCDKLRAHPLFKDLNWRQLEAGMLMPPFIPDSKTVYAKDIQDVGAFSTVKGVAFDKTDTEFFQEFATGNCPIPWQEEMIETGIFGELNVWRSDGQMPDDMKGISGGSSSSSKSGMCLVS

SEQ ID NO: 33618 - protein, 546 aa, Homo sapiens
  Payload ID: 6635
  Gene Symbol: GRK4
  Gene Name: G protein-coupled receptor kinase 4
  Uniprot ID: P32298
  ENSP ID: ENSP00000264764
MELENIVANSLLLKARQEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEMIESGCFKDINKSESEEALPLDLDKNIHTPVSRPNRGFFYRLFRRGGCLTMVPSEKEVEPKQC

SEQ ID NO: 33619 - protein, 500 aa, Homo sapiens
  Payload ID: 6635
  Gene Symbol: GRK4
  Gene Name: G protein-coupled receptor kinase 4
  Uniprot ID: P32298
  ENSP ID: ENSP00000381128
MELENIVANSLLLKARQEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEGCLTMVPSEKEVEPKQC

SEQ ID NO: 33620 - protein, 578 aa, Homo sapiens [sequence omitted]

SEQ ID NO: 33621 - protein, 84 aa, Homo sapiens
  Payload ID: 6635
  Gene Symbol: GRK4
  Gene Name: G protein-coupled receptor kinase 4
  ENSP ID: ENSP00000421650
MELENIVANSLLLKARQVLCIPPQKHQLVQPFSGRPPQSSVQSSVSDLMSPLPASQESWRQSLGPQVPVLATVVLHTPSLLRNC

SEQ ID NO: 33622 - protein, 532 aa, Homo sapiens
  Payload ID: 6635
  Gene Symbol: GRK4
  Gene Name: G protein-coupled receptor kinase 4
  Uniprot ID: P32298
  ENSP ID: ENSP00000427445
MELENIVANSLLLKARQGGYGKKSGRSKKWKEILTLPPVSQCSELRHSIEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEGCLTMVPSEKEVEPKQC

SEQ ID NO: 33623 - protein, 590 aa, Homo sapiens
  Payload ID: 6636
  Gene Symbol: GRK5
  Gene Name: G protein-coupled receptor kinase 5
  Uniprot ID: P34947
  ENSP ID: ENSP00000376609
MELENIVANTVLLKAREGGGGKRKGKSKKWKEILKFPHISQCEDLRRTIDRDYCSLCDKQPIGRLLFRQFCETRPGLECYIQFLDSVAEYEVTPDEKLGEKGKEIMTKYLTPKSPVFIAQVGQDLVSQTEEKLLQKPCKELFSACAQSVHEYLRGEPFHEYLDSMFFDRFLQWKWLERQPVTKNTFRQYRVLGKGGFGEVCACQVRATGKMYACKRLEKKRIKKRKGESMALNEKQILEKVNSQFVVNLAYAYETKDALCLVLTIMNGGDLKFHIYNMGNPGFEEERALFYAAEILCGLEDLHRENTVYRDLKPENILLDDYGHIRISDLGLAVKIPEGDLIRGRVGTVGYMAPEVLNNQRYGLSPDYWGLGCLIYEMIEGQSPFRGRKEKVKREEVDRRVLETEEVYSHKFSEEAKSICKMLLTKDAKQRLGCQEEGAAEVKRHPFFRNMNFKRLEAGMLDPPFVPDPRAVYCKDVLDIEQFSTVKGVNLDHTDDDFYSKFSTGSVSIPWQNEMIETECFKELNVFGPNGTLPPDLNRNHPPEPPKKGLLQRLFKRQHQNNSKSSPSSKTSFNHHINSNHVSSNSTGSS

SEQ ID NO: 33624 - protein, 576 aa, Homo sapiens
  Payload ID: 6637
  Gene Symbol: GRK6
  Gene Name: G protein-coupled receptor kinase 6
  Uniprot ID: P43250
  ENSP ID: ENSP00000347655
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQDCCGNCSDSEEELPTRL

SEQ ID NO: 33625 - protein, 560 aa, Homo sapiens
  Payload ID: 6637
  Gene Symbol: GRK6
  Gene Name: G protein-coupled receptor kinase 6
  Uniprot ID: P43250
  ENSP ID: ENSP00000348230
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQR

SEQ ID NO: 33626 - protein, 542 aa, Homo sapiens
  Payload ID: 6637
  Gene Symbol: GRK6
  Gene Name: G protein-coupled receptor kinase 6
  ENSP ID: ENSP00000377204
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQDCCGNCSDSEEELPTRL

SEQ ID NO: 33627 - protein, 253 aa, Homo sapiens
  Payload ID: 6637
  Gene Symbol: GRK6
  Gene Name: G protein-coupled receptor kinase 6
  ENSP ID: ENSP00000421055
MLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPE

SEQ ID NO: 33628 - protein, 17 aa, Homo sapiens
  Payload ID: 6637
  Gene Symbol: GRK6
  Gene Name: G protein-coupled receptor kinase 6
  ENSP ID: ENSP00000422342
MLQFPHISQCEELRLSL

SEQ ID NO: 33629 - protein, 63 aa, Homo sapiens
  Payload ID: 6637
  Gene Symbol: GRK6
  Gene Name: G protein-coupled receptor kinase 6
  ENSP ID: ENSP00000422873
MLQFPHISQCEELRLSLERDYHSLCERQPIGRLLFREFCATRPELSRCVAFLDGVAEYEVTPD

SEQ ID NO: 33630 - protein, 88 aa, Homo sapiens
  Payload ID: 6637
  Gene Symbol: GRK6
  Gene Name: G protein-coupled receptor kinase 6
  ENSP ID: ENSP00000423174
AEYEVTPDDKRKACGRQLTQNFLSHTADPRVPERGPFCRLPRQHLLQPFPAVEVAGKAASDQKHLQAIPSPGQRWLWGGVRLPGAGHR

SEQ ID NO: 33631 - protein, 129 aa, Homo sapiens
  Payload ID: 6637
  Gene Symbol: GRK6
  Gene Name: G protein-coupled receptor kinase 6
  ENSP ID: ENSP00000425391
MLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADY

SEQ ID NO: 33632 - protein, 475 aa, Homo sapiens
  Payload ID: 6637
  Gene Symbol: GRK6
  Gene Name: G protein-coupled receptor kinase 6
  ENSP ID: ENSP00000427581
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDVSAAHSC

SEQ ID NO: 33633 - protein, 589 aa, Homo sapiens
  Payload ID: 6637
  Gene Symbol: GRK6
  Gene Name: G protein-coupled receptor kinase 6
  Uniprot ID: P43250
  ENSP ID: ENSP00000433511
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQRIAVETAATARKSSPPASSPQPEAPTSSWR

SEQ ID NO: 33634 - protein, 553 aa, Homo sapiens
  Payload ID: 6638
  Gene Symbol: GRK7
  Gene Name: G protein-coupled receptor kinase 7
  Uniprot ID: Q8WTQ7
  ENSP ID: ENSP00000264952
MVDMGALDNLIANTAYLQARKPSDCDSKELQRRRRSLALPGLQGCAELRQKLSLNFHSLCEQQPIGRRLFRDFLATVPTFRKAATFLEDVQNWELAEEGPTKDSALQGLVATCASAPAPGNPQPFLSQAVATKCQAATTEEERVAAVTLAKAEAMAFLQEQPFKDFVTSAFYDKFLQWKLFEMQPVSDKYFTEFRVLGKGGFGEVCAVQVKNTGKMYACKKLDKKRLKKKGGEKMALLEKEILEKVSSPFIVSLAYAFESKTHLCLVMSLMNGGDLKFHIYNVGTRGLDMSRVIFYSAQIACGMLHLHELGIVYRDMKPENVLLDDLGNCRLSDLGLAVEMKGGKPITQRAGTNGYMAPEILMEKVSYSYPVDWFAMGCSIYEMVAGRTPFKDYKEKVSKEDLKQRTLQDEVKFQHDNFTEEAKDICRLFLAKKPEQRLGSREKSDDPRKHHFFKTINFPRLEAGLIEPPFVPDPSVVYAKDIAEIDDFSEVRGVEFDDKDKQFFKNFATGAVPIAWQEEIIETGLFEELNDPNRPTGCEEGNSSKSGVCLLL

SEQ ID NO: 33635 - protein, 761 aa, Homo sapiens
  Payload ID: 6639
  Gene Symbol: GIT1
  Gene Name: G protein-coupled receptor kinase interacting ArfGAP 1
  Uniprot ID: Q9Y2X7
  ENSP ID: ENSP00000225394
MSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 33636 - protein, 147 aa, Homo sapiens
  Payload ID: 6639
  Gene Symbol: GIT1
  Gene Name: G protein-coupled receptor kinase interacting ArfGAP 1
  ENSP ID: ENSP00000334125
MSRKGPRAEVCADCSAPGVCWCVTSAAACTGAWDATSPLSSTFATAPGLPRCCRWCTRLPATGPTPSGSTPCWTPHKCRAAGVKPTPKTKSTPSSQSSSGPSTRCWHLCTSFPAGTMMESPPKTSASNYTRACGQATWRHVCACSPW

SEQ ID NO: 33637 - protein, 770 aa, Homo sapiens
  Payload ID: 6639
  Gene Symbol: GIT1
  Gene Name: G protein-coupled receptor kinase interacting ArfGAP 1
  Uniprot ID: Q9Y2X7
  ENSP ID: ENSP00000378338
MSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADRSRQKCMSQSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 33638 - protein, 747 aa, Homo sapiens
  Payload ID: 6639
  Gene Symbol: GIT1
  Gene Name: G protein-coupled receptor kinase interacting ArfGAP 1
  ENSP ID: ENSP00000462775
MSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADRSRQKCMSQSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYREGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 33639 - protein, 177 aa, Homo sapiens
  Payload ID: 6639
  Gene Symbol: GIT1
  Gene Name: G protein-coupled receptor kinase interacting ArfGAP 1
  ENSP ID: ENSP00000463435
ELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKVQGPKRGPGVGGPRAGAGVENPI

SEQ ID NO: 33640 - protein, 228 aa, Homo sapiens
  Payload ID: 6639
  Gene Symbol: GIT1
  Gene Name: G protein-coupled receptor kinase interacting ArfGAP 1
  ENSP ID: ENSP00000463543
DHKNGHYIIPQMADSLDLSELAKAAKKKLQALSNRLFEELAMDVYDEVDRRENDAVWLATQNHSTLVTERSAVPFLPVNPEYSATRNQGRQKLARFNAREFATLIIDILNNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPL

SEQ ID NO: 33641 - protein, 149 aa, Homo sapiens
  Payload ID: 6639
  Gene Symbol: GIT1
  Gene Name: G protein-coupled receptor kinase interacting ArfGAP 1
  ENSP ID: ENSP00000463746
  MOD_RES (1)..(1): Any amino acid
XENLQLRQPPGPVPTPPLPSERAEHTPMAPGGSTHRRDRQAFSMYEPGSALKPFGGPPGDELTTRLQPFHSTELEDDAIYSVHVPAGLYRAGREEVSRAGQRGRLPPRAGKPGWRPRSWASQHRGCHLEDRAGHQEHSGTVAGSPGVQA

SEQ ID NO: 33642 - protein, 694 aa, Homo sapiens
  Payload ID: 6639
  Gene Symbol: GIT1
  Gene Name: G protein-coupled receptor kinase interacting ArfGAP 1
  ENSP ID: ENSP00000464388
MSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKLVA

SEQ ID NO: 33643 - protein, 52 aa, Homo sapiens
  Payload ID: 6639
  Gene Symbol: GIT1
  Gene Name: G protein-coupled receptor kinase interacting ArfGAP 1
  ENSP ID: ENSP00000464933
MVHTLASNGANSIWEHSLLDPAQVQSGRRKANPQDKVHPIKSEFIRAKYQML

SEQ ID NO: 33644 - protein, 173 aa, Homo sapiens
  Payload ID: 6639
  Gene Symbol: GIT1
  Gene Name: G protein-coupled receptor kinase interacting ArfGAP 1
  ENSP ID: ENSP00000466824
MEHRHSPQPLPAALTAPAEEGHRGLYSHLDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANF

SEQ ID NO: 33645 - protein, 421 aa, Homo sapiens
  Payload ID: 6640
  Gene Symbol: GIT2
  Gene Name: G protein-coupled receptor kinase interacting ArfGAP 2
  ENSP ID: ENSP00000323833
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKLLGKDAN

SEQ ID NO: 33646 - protein, 681 aa, Homo sapiens [sequence omitted]

SEQ ID NO: 33647 - protein, 759 aa, Homo sapiens
  Payload ID: 6640
  Gene Symbol: GIT2
  Gene Name: G protein-coupled receptor kinase interacting ArfGAP 2
  Uniprot ID: Q14161
  ENSP ID: ENSP00000347464
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 33648 - protein, 729 aa, Homo sapiens
  Payload ID: 6640
  Gene Symbol: GIT2
  Gene Name: G protein-coupled receptor kinase interacting ArfGAP 2
  Uniprot ID: Q14161
  ENSP ID: ENSP00000354282
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 33649 - protein, 681 aa, Homo sapiens
  Payload ID: 6640
  Gene Symbol: GIT2
  Gene Name: G protein-coupled receptor kinase interacting ArfGAP 2
  Uniprot ID: Q14161
  ENSP ID: ENSP00000391813
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADRRLSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKLQTLQSENSNLRKQATTNVYQVQTGSEYTDTSNHSSLKRRPSARGSRPMSMYETGSGQKPYLPMGEASRPEESRMRLQPFPAHASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 33650 - protein, 631 aa, Homo sapiens
  Payload ID: 6640
  Gene Symbol: GIT2
  Gene Name: G protein-coupled receptor kinase interacting ArfGAP 2
  Uniprot ID: Q14161
  ENSP ID: ENSP00000447465
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 33651 - protein, 708 aa, Homo sapiens
  Payload ID: 6640
  Gene Symbol: GIT2
  Gene Name: G protein-coupled receptor kinase interacting ArfGAP 2
  ENSP ID: ENSP00000448832
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 33652 - protein, 471 aa, Homo sapiens
  Payload ID: 6640
  Gene Symbol: GIT2
  Gene Name: G protein-coupled receptor kinase interacting ArfGAP 2
  Uniprot ID: Q14161
  ENSP ID: ENSP00000450348
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLLGKDAN

SEQ ID NO: 33653 - protein, 641 aa, Homo sapiens
  Payload ID: 6640
  Gene Symbol: GIT2
  Gene Name: G protein-coupled receptor kinase interacting ArfGAP 2
  ENSP ID: ENSP00000473637
MVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQ

SEQ ID NO: 33654 - protein, 357 aa, Homo sapiens
  Payload ID: 6641
  Gene Symbol: GPRC5A
  Gene Name: G protein-coupled receptor, class C, group 5, member A
  Uniprot ID: Q8NFJ5
  ENSP ID: ENSP00000014914
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 33655 - protein, 66 aa, Homo sapiens
  Payload ID: 6641
  Gene Symbol: GPRC5A
  Gene Name: G protein-coupled receptor, class C, group 5, member A
  ENSP ID: ENSP00000439430
PMDYPVEDAFCKPQLVKKSYGVENRAYSQEEITQGFEETGDTLYAPYSTHFQLQVSDFFLPLHQRH

SEQ ID NO: 33656 - protein, 273 aa, Homo sapiens
  Payload ID: 6641
  Gene Symbol: GPRC5A
  Gene Name: G protein-coupled receptor, class C, group 5, member A
  ENSP ID: ENSP00000441627
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRN

SEQ ID NO: 33657 - protein, 403 aa, Homo sapiens
  Payload ID: 6642
  Gene Symbol: GPRC5B
  Gene Name: G protein-coupled receptor, class C, group 5, member B
  Uniprot ID: Q9NZH0
  ENSP ID: ENSP00000300571
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 33658 - protein, 404 aa, Homo sapiens
  Payload ID: 6642
  Gene Symbol: GPRC5B
  Gene Name: G protein-coupled receptor, class C, group 5, member B
  Uniprot ID: Q9NZH0
  ENSP ID: ENSP00000442858
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTEMVTHPRSLESFGAF

SEQ ID NO: 33659 - protein, 177 aa, Homo sapiens
  Payload ID: 6642
  Gene Symbol: GPRC5B
  Gene Name: G protein-coupled receptor, class C, group 5, member B
  ENSP ID: ENSP00000454667
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIA

SEQ ID NO: 33660 - protein, 403 aa, Homo sapiens; identical to SEQ ID NO: 33657
  Payload ID: 6642
  Gene Symbol: GPRC5B
  Gene Name: G protein-coupled receptor, class C, group 5, member B
  Uniprot ID: Q9NZH0
  ENSP ID: ENSP00000454727

SEQ ID NO: 33661 - protein, 148 aa, Homo sapiens
  Payload ID: 6642
  Gene Symbol: GPRC5B
  Gene Name: G protein-coupled receptor, class C, group 5, member B
  ENSP ID: ENSP00000455960
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVR

SEQ ID NO: 33662 - protein, 86 aa, Homo sapiens
  Payload ID: 6642
  Gene Symbol: GPRC5B
  Gene Name: G protein-coupled receptor, class C, group 5, member B
  ENSP ID: ENSP00000456724
MFVASERKMRAHQVLTFLLLFVITSVASENASTSRGCGLDLLPQYVSLCDLDAIWGIVVEAVAGAGALITLLLMLILLVRLPFIKE

SEQ ID NO: 33663 - protein, 25 aa, Homo sapiens
  Payload ID: 6642
  Gene Symbol: GPRC5B
  Gene Name: G protein-coupled receptor, class C, group 5, member B
  ENSP ID: ENSP00000457018
MFVASERKMRAHQVLTFLLLFVITS

SEQ ID NO: 33664 - protein, 90 aa, Homo sapiens
  Payload ID: 6642
  Gene Symbol: GPRC5B
  Gene Name: G protein-coupled receptor, class C, group 5, member B
  ENSP ID: ENSP00000457080
MFVASERKMRAHQVLTFLLLFVITSVASENASTSRGCGLDLLPQYVSLCDLDAIWGIVVEAVAGAGALITLLLMLILLVRLPFIKEKEKK

SEQ ID NO: 33665 - protein, 403 aa, Homo sapiens; identical to SEQ ID NO: 33657
  Payload ID: 6642
  Gene Symbol: GPRC5B
  Gene Name: G protein-coupled receptor, class C, group 5, member B
  Uniprot ID: Q9NZH0
  ENSP ID: ENSP00000457283

SEQ ID NO: 33666 - protein, 126 aa, Homo sapiens
  Payload ID: 6643
  Gene Symbol: GPRC5C
  Gene Name: G protein-coupled receptor, class C, group 5, member C
  ENSP ID: ENSP00000340595
MYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 33667 - protein, 486 aa, Homo sapiens
  Payload ID: 6643
  Gene Symbol: GPRC5C
  Gene Name: G protein-coupled receptor, class C, group 5, member C
  ENSP ID: ENSP00000376403
MRGRGSQQQQPTRRQGQKLPSPSPAGKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 33668 - protein, 462 aa, Homo sapiens
  Payload ID: 6643
  Gene Symbol: GPRC5C
  Gene Name: G protein-coupled receptor, class C, group 5, member C
  ENSP ID: ENSP00000376404
  MOD_RES (1)..(1): Any amino acid
XKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQAQSPQSKTRW

SEQ ID NO: 33669 - protein, 453 aa, Homo sapiens
  Payload ID: 6643
  Gene Symbol: GPRC5C
  Gene Name: G protein-coupled receptor, class C, group 5, member C
  Uniprot ID: Q9NQ84
  ENSP ID: ENSP00000376405
MGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 33670 - protein, 150 aa, Homo sapiens
  Payload ID: 6643
  Gene Symbol: GPRC5C
  Gene Name: G protein-coupled receptor, class C, group 5, member C
  ENSP ID: ENSP00000462147
MRGRGSQQQQPTRRQGQKLPSPSPAGKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQLRGRCHHTAGTMGSC

SEQ ID NO: 33671 - protein, 153 aa, Homo sapiens
  Payload ID: 6643
  Gene Symbol: GPRC5C
  Gene Name: G protein-coupled receptor, class C, group 5, member C
  ENSP ID: ENSP00000462440
MQAPAHPRRKQGALPGDRPARERATQRAWLSLGPRERQALRPGPGPAIPARTGPGPAPRAASLPPPPAPRLGLELAPNAALERGRRRVPGTQPEPGLGARMAIHKALVMCLGLPLFLFPGAWAQGHVPPGCSQGLNPLYYNLCDRSGAWGIVL

SEQ ID NO: 33672 - protein, 355 aa, Homo sapiens
  Payload ID: 6643
  Gene Symbol: GPRC5C
  Gene Name: G protein-coupled receptor, class C, group 5, member C
  ENSP ID: ENSP00000463090
  MOD_RES (1)..(1): Any amino acid
XNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQDDDQSSSLERCPVVSPTALWCYPRPQQPVPLSLAYFSRAKLGEQSLQSRIAALTVAPDLSVLPVEVHEQNVISLQWKGSRELCGPHAALGLA

SEQ ID NO: 33673 - protein, 145 aa, Homo sapiens
  Payload ID: 6643
  Gene Symbol: GPRC5C
  Gene Name: G protein-coupled receptor, class C, group 5, member C
  ENSP ID: ENSP00000463813
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLA

SEQ ID NO: 33674 - protein, 345 aa, Homo sapiens
  Payload ID: 6644
  Gene Symbol: GPRC5D
  Gene Name: G protein-coupled receptor, class C, group 5, member D
  Uniprot ID: Q9NZD1
  ENSP ID: ENSP00000228887
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRARDSDGAEEDVALTSYGTPIQPQTVDPTQECFIPQAKLSPQQDAGGV

SEQ ID NO: 33675 - protein, 300 aa, Homo sapiens
  Payload ID: 6644
  Gene Symbol: GPRC5D
  Gene Name: G protein-coupled receptor, class C, group 5, member D
  Uniprot ID: Q9NZD1
  ENSP ID: ENSP00000379624
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRDC

SEQ ID NO: 33676 - protein, 120 aa, Homo sapiens
  Payload ID: 6644
  Gene Symbol: GPRC5D
  Gene Name: G protein-coupled receptor, class C, group 5, member D
  ENSP ID: ENSP00000440530
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRG

SEQ ID NO: 33677 - protein, 926 aa, Homo sapiens
  Payload ID: 6645
  Gene Symbol: GPRC6A
  Gene Name: G protein-coupled receptor, class C, group 6, member A
  Uniprot ID: Q5T6X5
  ENSP ID: ENSP00000309493
MAFLIILITCFVIILATSQPCQTPDDFVAATSPGHIIIGGLFAIHEKMLSSEDSPRRPQIQECVGFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAIEMNINKMWIASDNWSTATKITTIPNVKKIGKVVGFAFRRGNISSFHSFLQNLHLLPSDSHKLLHEYAMHLSACAYVKDTDLSQCIFNHSQRTLAYKANKAIERNFVMRNDFLWDYAEPGLIHSIQLAVFALGYAIRDLCQARDCQNPNAFQPWELLGVLKNVTFTDGWNSFHFDAHGDLNTGYDVVLWKEINGHMTVTKMAEYDLQNDVFIIPDQETKNEFRNLKQIQSKCSKECSPGQMKKTTRSQHICCYECQNCPENHYTNQTDMPHCLLCNNKTHWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQAQAFAHICRENATSVSKTLPRKRMSSI

SEQ ID NO: 33678 - protein, 855 aa, Homo sapiens
  Payload ID: 6645
  Gene Symbol: GPRC6A
  Gene Name: G protein-coupled receptor, class C, group 6, member A
  Uniprot ID: Q5T6X5
  ENSP ID: ENSP00000357537
MAFLIILITCFVIILATSQPCQTPDDFVAATSPGHIIIGGLFAIHEKMLSSEDSPRRPQIQECVGFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAIEMNINKMWIASDNWSTATKITTIPNVKKIGKVVGFAFRRGNISSFHSFLQNLHLLPSDSHKLLHEYAMHLSACAYVKDTDLSQCIFNHSQRTLAYKANKAIERNFVMRNDFLWDYAEPGLIHSIQLAVFALGYAIRDLCQARDCQNPNAFQPWEQIQSKCSKECSPGQMKKTTRSQHICCYECQNCPENHYTNQTDMPHCLLCNNKTHWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQAQAFAHICRENATSVSKTLPRKRMSSI

SEQ ID NO: 33679 - protein, 751 aa, Homo sapiens
  Payload ID: 6645
  Gene Symbol: GPRC6A
  Gene Name: G protein-coupled receptor, class C, group 6, member A
  Uniprot ID: Q5T6X5
  ENSP ID: ENSP00000433465
MAFLIILITCFVIILATSQPCQTPDDFVAATSPGHIIIGGLFAIHEKMLSSEDSPRRPQIQECVGFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQLLGVLKNVTFTDGWNSFHFDAHGDLNTGYDVVLWKEINGHMTVTKMAEYDLQNDVFIIPDQETKNEFRNLKQIQSKCSKECSPGQMKKTTRSQHICCYECQNCPENHYTNQTDMPHCLLCNNKTHWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQAQAFAHICRENATSVSKTLPRKRMSSI

SEQ ID NO: 33680 - protein, 103 aa, Homo sapiens
  Payload ID: 6646
  Gene Symbol: G0S2
  Gene Name: G0/G1 switch 2
  Uniprot ID: P27469
  ENSP ID: ENSP00000355996
METVQELIPLAKEMMAQKRKGKMVKLYVLGSVLALFGVVLGLMETVCSPFTAARRLRDQEAAVAELQAALERQALQKQALQEKGKQQDTVLGGRALSNRQHAS

SEQ ID NO: 33681 - protein, 637 aa, Homo sapiens
  Payload ID: 6647
  Gene Symbol: GSPT1
  Gene Name: G1 to S phase transition 1
  Uniprot ID: P15170
  ENSP ID: ENSP00000398131
MDPGSGGGGGGGGGGGSSSGSSSSDSAPDCWDQADMEAPGPGPCGGGGSLAAAAEAQRENLSAAFSRQLNVNAKPFVPNVHAAEFVPSFLRGPAAPPPPVGGAANNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 33682 - protein, 499 aa, Homo sapiens
  Payload ID: 6647
  Gene Symbol: GSPT1
  Gene Name: G1 to S phase transition 1
  Uniprot ID: P15170
  ENSP ID: ENSP00000399539
MELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 33683 - protein, 636 aa, Homo sapiens
  Payload ID: 6647
  Gene Symbol: GSPT1
  Gene Name: G1 to S phase transition 1
  Uniprot ID: P15170
  ENSP ID: ENSP00000408399
MDPGSGGGGGGGGGGGSSSGSSSSDSAPDCWDQADMEAPGPGPCGGGGSLAAAAEAQRENLSAAFSRQLNVNAKPFVPNVHAAEFVPSFLRGPAAPPPPVGGAANNHGAGSGAGGRAAPVESSQEEQSLCEGSNSAVSMELSEPIENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 33684 - protein, 499 aa, Homo sapiens; identical to SEQ ID NO: 33682
  Payload ID: 6647
  Gene Symbol: GSPT1
  Gene Name: G1 to S phase transition 1
  Uniprot ID: P15170
  ENSP ID: ENSP00000454351

SEQ ID NO: 33685 - protein, 94 aa, Homo sapiens
  Payload ID: 6647
  Gene Symbol: GSPT1
  Gene Name: G1 to S phase transition 1
  ENSP ID: ENSP00000454538
MRTDGARSHLAPVESSQEEQSLCEGSNSAVSMELSEPIENGETEMSPEESWEHKEEISEAEPGGGSLGDGRPPEESAHEMMEEEEEIPKPKSVV

SEQ ID NO: 33686 - protein, 475 aa, Homo sapiens
  Payload ID: 6647
  Gene Symbol: GSPT1
  Gene Name: G1 to S phase transition 1
  ENSP ID: ENSP00000456057
  MOD_RES (1)..(1): Any amino acid
XSNSAVSMELSEPIENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQALICLVDKKSGEKSKTRPRFVKQDQVCIARLRTAGTICLETFKDFPQMGRFTLRDEGKTIAIGKVLKLVPEKD

SEQ ID NO: 33687 - protein, 199 aa, Homo sapiens
  Payload ID: 6647
  Gene Symbol: GSPT1
  Gene Name: G1 to S phase transition 1
  ENSP ID: ENSP00000456897
MRTDGARSHLAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPN

SEQ ID NO: 33688 - protein, 628 aa, Homo sapiens
  Payload ID: 6648
  Gene Symbol: GSPT2
  Gene Name: G1 to S phase transition 2
  Uniprot ID: Q8IYD1
  ENSP ID: ENSP00000341247
MDSGSSSSDSAPDCWDQVDMESPGSAPSGDGVSSAVAEAQREPLSSAFSRKLNVNAKPFVPNVHAAEFVPSFLRGPTQPPTLPAGSGSNDETCTGAGYPQGKRMGRGAPVEPSREEPLVSLEGSNSAVTMELSEPVVENGEVEMALEESWEHSKEVSEAEPGGGSSGDSGPPEESGQEMMEEKEEIRKSKSVIVPSGAPKKEHVNVVFIGHVDAGKSTIGGQIMFLTGMVDKRTLEKYEREAKEKNRETWYLSWALDTNQEERDKGKTVEVGRAYFETERKHFTILDAPGHKSFVPNMIGGASQADLAVLVISARKGEFETGFEKGGQTREHAMLAKTAGVKHLIVLINKMDDPTVNWSIERYEECKEKLVPFLKKVGFSPKKDIHFMPCSGLTGANIKEQSDFCPWYTGLPFIPYLDNLPNFNRSIDGPIRLPIVDKYKDMGTVVLGKLESGSIFKGQQLVMMPNKHNVEVLGILSDDTETDFVAPGENLKIRLKGIEEEEILPGFILCDPSNLCHSGRTFDVQIVIIEHKSIICPGYNAVLHIHTCIEEVEITALISLVDKKSGEKSKTRPRFVKQDQVCIARLRTAGTICLETFKDFPQMGRFTLRDEGKTIAIGKVLKLVPEKD

SEQ ID NO: 33689 - protein, 739 aa, Homo sapiens
  Payload ID: 6649
  Gene Symbol: GTSE1
  Gene Name: G-2 and S-phase expressed 1
  Uniprot ID: Q9NYZ3
  ENSP ID: ENSP00000415430
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSAWRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 33690 - protein, 706 aa, Homo sapiens
  Payload ID: 6650
  Gene Symbol: G2E3
  Gene Name: G2/M-phase specific E3 ubiquitin protein ligase
  Uniprot ID: Q7L622
  ENSP ID: ENSP00000206595
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKDASWELEENAYQELLQHYERCDVRRCRCKEGRDYNAPDSKWEIKRCQCCGSSGTHLACSSLRSWEQNWECLECRGIIYNSGEFQKAKKHVLPNSNNVGITDCLLEESSPKLPRQSPGSQSKDLLRQGSKFRRNVSTLLIELGFQIKKKTKRLYINKANIWNSALDAFRNRNFNPSYAIEVAYVIENDNFGSEHPGSKQEFLSLLMQHLENSSLFEGSLSKNLSLNSQALKENLYYEAGKMLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTLPDVKALGFWNSYLQAVEDGKSTTTMEDILIFATGCSSIPPAGFKPTPSIECLHVDFPVGNKCNNCLAIPITNTYKEFQENMDFTIRNTLRLEKEESSHYIGH

SEQ ID NO: 33691 - protein, 660 aa, Homo sapiens
  Payload ID: 6650
  Gene Symbol: G2E3
  Gene Name: G2/M-phase specific E3 ubiquitin protein ligase
  ENSP ID: ENSP00000391068
MSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKDASWELEENAYQELLQHYERCDVRRCRCKEGRDYNAPDSKWEIKRCQCCGSSGTHLACSSLRSWEQNWECLECRGIIYNSGEFQKAKKHVLPNSNNVGITDCLLEESSPKLPRQSPGSQSKDLLRQGSKFRRNVSTLLIELGFQIKKKTKRLYINKANIWNSALDAFRNRNFNPSYAIEVAYVIENDNFGSEHPGSKQEFLSLLMQHLENSSLFEGSLSKNLSLNSQALKENLYYEAGKMLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTLPDVKALGFWNSYLQAVEDGKSTTTMEDILIFATGCSSIPPAGFKPTPSIECLHVDFPVGNKCNNCLAIPITNTYKEFQENMDFTIRNTLRLEKEESSHYIGH

SEQ ID NO: 33692 - protein, 101 aa, Homo sapiens
  Payload ID: 6650
  Gene Symbol: G2E3
  Gene Name: G2/M-phase specific E3 ubiquitin protein ligase
  ENSP ID: ENSP00000446535
  MOD_RES (1)..(1): Any amino acid
XCRCKEGRDYNAPDSKWEIKRCQCCGSSGTHLACSSLRSWEQNWECLECRGIIYNSGEFQKAKKHVLPNSNNVGITDCLLEESSPKLPRQSPGSQSKDLLR

SEQ ID NO: 33693 - protein, 176 aa, Homo sapiens
  Payload ID: 6650
  Gene Symbol: G2E3
  Gene Name: G2/M-phase specific E3 ubiquitin protein ligase
  ENSP ID: ENSP00000446615
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQ

SEQ ID NO: 33694 - protein, 123 aa, Homo sapiens
  Payload ID: 6650
  Gene Symbol: G2E3
  Gene Name: G2/M-phase specific E3 ubiquitin protein ligase
  ENSP ID: ENSP00000448515
  MOD_RES (1)..(1): Any amino acid
XEVLVVRTLGFIETVYSKWEIKRCQCCGSSGTHLACSSLRSWEQNWECLECRGIIYNSGEFQKAKKHVLPNSNNVGITDCLLEESSPKLPRQSPGSQSKDLLRQGSKFRRNVSTLLIELGFQI

SEQ ID NO: 33695 - protein, 120 aa, Homo sapiens
  Payload ID: 6650
  Gene Symbol: G2E3
  Gene Name: G2/M-phase specific E3 ubiquitin protein ligase
  ENSP ID: ENSP00000448745
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNF

SEQ ID NO: 33696 - protein, 131 aa, Homo sapiens
  Payload ID: 6650
  Gene Symbol: G2E3
  Gene Name: G2/M-phase specific E3 ubiquitin protein ligase
  ENSP ID: ENSP00000451147
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQ

SEQ ID NO: 33697 - protein, 736 aa, Homo sapiens
  Payload ID: 6650
  Gene Symbol: G2E3
  Gene Name: G2/M-phase specific E3 ubiquitin protein ligase
  ENSP ID: ENSP00000451653
MLIPALQISDSESVGLEDGIEQSAYLTESKMNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKDASWELEENAYQELLQHYERCDVRRCRCKEGRDYNAPDSKWEIKRCQCCGSSGTHLACSSLRSWEQNWECLECRGIIYNSGEFQKAKKHVLPNSNNVGITDCLLEESSPKLPRQSPGSQSKDLLRQGSKFRRNVSTLLIELGFQIKKKTKRLYINKANIWNSALDAFRNRNFNPSYAIEVAYVIENDNFGSEHPGSKQEFLSLLMQHLENSSLFEGSLSKNLSLNSQALKENLYYEAGKMLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTLPDVKALGFWNSYLQAVEDGKSTTTMEDILIFATGCSSIPPAGFKPTPSIECLHVDFPVGNKCNNCLAIPITNTYKEFQENMDFTIRNTLRLEKEESSHYIGH

SEQ ID NO: 33698 - protein, 79 aa, Homo sapiens
  Payload ID: 6650
  Gene Symbol: G2E3
  Gene Name: G2/M-phase specific E3 ubiquitin protein ligase
  ENSP ID: ENSP00000452275
MNESKPGDSQNLACVFCRKHDDCPNKYGEKKTKEKWNLTVHYYCLLMSSGIWQRGKEEEGVYGFLIEDIRKEVNRASKL

SEQ ID NO: 33699 - protein, 454 aa, Homo sapiens
  Payload ID: 6651
  Gene Symbol: GABPA
  Gene Name: GA binding protein transcription factor, alpha subunit 60kDa
  Uniprot ID: Q06546
  ENSP ID: ENSP00000346886
MTKREAEELIEIEIDGTEKAECTEESIVEQTYAPAECVSQAIDINEPIGNLKKLLEPRLQCSLDAHEICLQDIQLDPERSLFDQGVKTDGTVQLSVQVISYQGIEPKLNILEIVKPADTVEVVIDPDAHHAESEAHLVEEAQVITLDGTKHITTISDETSEQVTRWAAALEGYRKEQERLGIPYDPIQWSTDQVLHWVVWVMKEFSMTDIDLTTLNISGRELCSLNQEDFFQRVPRGEILWSHLELLRKYVLASQEQQMNEIVTIDQPVQIIPASVQSATPTTIKVINSSAKAAKVQRAPRISGEDRSSPGNRTGNNGQIQLWQFLLELLTDKDARDCISWVGDEGEFKLNQPELVAQKWGQRKNKPTMNYEKLSRALRYYYDGDMICKVQGKRFVYKFVCDLKTLIGYSAAELNRLVTECEQKKLAKMQLHGIAQPVTAVALATASLQTEKDN

SEQ ID NO: 33700 - protein, 454 aa, Homo sapiens; identical to SEQ ID NO: 33699
  Payload ID: 6651
  Gene Symbol: GABPA
  Gene Name: GA binding protein transcription factor, alpha subunit 60kDa
  Uniprot ID: Q06546
  ENSP ID: ENSP00000382948

SEQ ID NO: 33701 - protein, 395 aa, Homo sapiens
  Payload ID: 6652
  Gene Symbol: GABPB1
  Gene Name: GA binding protein transcription factor, beta subunit 1
  Uniprot ID: Q06547
  ENSP ID: ENSP00000220429
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 33702 - protein, 348 aa, Homo sapiens
  Payload ID: 6652
  Gene Symbol: GABPB1
  Gene Name: GA binding protein transcription factor, beta subunit 1
  Uniprot ID: Q06547
  ENSP ID: ENSP00000351923
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEVRSLLPGVLCRSHPK

SEQ ID NO: 33703 - protein, 383 aa, Homo sapiens
  Payload ID: 6652
  Gene Symbol: GABPB1
  Gene Name: GA binding protein transcription factor, beta subunit 1
  Uniprot ID: Q06547
  ENSP ID: ENSP00000370259
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 33704 - protein, 348 aa, Homo sapiens; identical to SEQ ID NO: 33702
  Payload ID: 6652
  Gene Symbol: GABPB1
  Gene Name: GA binding protein transcription factor, beta subunit 1
  Uniprot ID: Q06547
  ENSP ID: ENSP00000379728

SEQ ID NO: 33705 - protein, 360 aa, Homo sapiens
  Payload ID: 6652
  Gene Symbol: GABPB1
  Gene Name: GA binding protein transcription factor, beta subunit 1
  Uniprot ID: Q06547
  ENSP ID: ENSP00000395771
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEVRSLLPGVLCRSHPK

SEQ ID NO: 33706 - protein, 319 aa, Homo sapiens
  Payload ID: 6652
  Gene Symbol: GABPB1
  Gene Name: GA binding protein transcription factor, beta subunit 1
  ENSP ID: ENSP00000442500
MAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 33707 - protein, 347 aa, Homo sapiens
  Payload ID: 6652
  Gene Symbol: GABPB1
  Gene Name: GA binding protein transcription factor, beta subunit 1
  ENSP ID: ENSP00000453463
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTDETGVSAVQFGNSSTSVLATLAALAEASAPLSNSSETPVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEVRSLLPGVLCRSHPK

SEQ ID NO: 33708 - protein, 89 aa, Homo sapiens
  Payload ID: 6652
  Gene Symbol: GABPB1
  Gene Name: GA binding protein transcription factor, beta subunit 1
  ENSP ID: ENSP00000453578
MSLVDLGKKLLEAARAGQDDEVRILMANGAPFTTDWLGTSPLHLAAQYGHYSTTEVLLRAGVSRDARTKVDRTPLHMAASEGHASIVEV

SEQ ID NO: 33709 - protein, 203 aa, Homo sapiens
  Payload ID: 6652
  Gene Symbol: GABPB1
  Gene Name: GA binding protein transcription factor, beta subunit 1
  ENSP ID: ENSP00000453806
  MOD_RES (1)..(1): Any amino acid
XIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIERGCLAMLPRLVLDSWPQVILPPQPPEELRLLA

SEQ ID NO: 33710 - protein, 89 aa, Homo sapiens; identical to SEQ ID NO: 33708
  Payload ID: 6652
  Gene Symbol: GABPB1
  Gene Name: GA binding protein transcription factor, beta subunit 1
  ENSP ID: ENSP00000454211

SEQ ID NO: 33711 - protein, 410 aa, Homo sapiens
  Payload ID: 6653
  Gene Symbol: GABPB2
  Gene Name: GA binding protein transcription factor, beta subunit 2
  ENSP ID: ENSP00000357912
MSLVDLGKRLLEAARKGQDDEVRTLMANGAPFTTDWLGTSPLHLAAQYGHYSTAEVLLRAGVSRDARTKVDRTPLHMAAADGHAHIVELLVRNGADVNAKDMLKMTALHWATERHHRDVVELLIKYGADVHAFSKFDKSAFDIALEKNNAEILVILQEAMQNQVNVNPERANPVTDPVSMAAPFIFTSGEVVNLASLISSTNTKTTSANTEEIIEGNSVDSSIQQVMGSGGQRVITIVTDGVPLGNIQTSIPTGGIGQPFIVTVQDGQQVLTVPAGKVAEETVIKEEEEEKLPLTKKPRIGEKTNSVEESKEGNERELLQQQLQEANRRAQEYRHQLLKKEQEAEQYRLKLEAIARQQPNGVDFTMVEEVAEVDAVVVTEGELEERETKVTGSAGTTEPHTRVSMATVSS

SEQ ID NO: 33712 - protein, 448 aa, Homo sapiens
  Payload ID: 6653
  Gene Symbol: GABPB2
  Gene Name: GA binding protein transcription factor, beta subunit 2
  Uniprot ID: Q8TAK5
  ENSP ID: ENSP00000357914
MSLVDLGKRLLEAARKGQDDEVRTLMANGAPFTTDWLGTSPLHLAAQYGHYSTAEVLLRAGVSRDARTKVDRTPLHMAAADGHAHIVELLVRNGADVNAKDMLKMTALHWATERHHRDVVELLIKYGADVHAFSKFDKSAFDIALEKNNAEILVILQEAMQNQVNVNPERANPVTDPVSMAAPFIFTSGEVVNLASLISSTNTKTTSGDPHASTVQFSNSTTSVLATLAALAEASVPLSNSHRATANTEEIIEGNSVDSSIQQVMGSGGQRVITIVTDGVPLGNIQTSIPTGGIGQPFIVTVQDGQQVLTVPAGKVAEETVIKEEEEEKLPLTKKPRIGEKTNSVEESKEGNERELLQQQLQEANRRAQEYRHQLLKKEQEAEQYRLKLEAIARQQPNGVDFTMVEEVAEVDAVVVTEGELEERETKVTGSAGTTEPHTRVSMATVSS

SEQ ID NO: 33713 - protein, 117 aa, Homo sapiens
  Payload ID: 6654
  Gene Symbol: GABARAP
  Gene Name: GABA(A) receptor-associated protein
  Uniprot ID: O95166
  ENSP ID: ENSP00000306866
MKFVYKEEHPFEKRRSEGEKIRKKYPDRVPVIVEKAPKARIGDLDKKKYLVPSDLTVGQFYFLIRKRIHLRAEDALFFFVNNVIPPTSATMGQLYQEHHEEDFFLYIAYSDESVYGL

SEQ ID NO: 33714 - protein, 98 aa, Homo sapiens
  Payload ID: 6654
  Gene Symbol: GABARAP
  Gene Name: GABA(A) receptor-associated protein
  ENSP ID: ENSP00000458476
MKFVYKEEHPFEKRRSEGEKIRKKYPDRVPVIVEKAPKARIGDLDKKKYLVPSDLTVGQFYFLIRKRIHLRAEDALFFFVNNVIPPTSATMGQLYQVW

SEQ ID NO: 33715 - protein, 27 aa, Homo sapiens
  Payload ID: 6654
  Gene Symbol: GABARAP
  Gene Name: GABA(A) receptor-associated protein
  ENSP ID: ENSP00000459345
MGQLYQEHHEEDFFLYIAYSDESVYGL

SEQ ID NO: 33716 - protein, 36 aa, Homo sapiens
  Payload ID: 6654
  Gene Symbol: GABARAP
  Gene Name: GABA(A) receptor-associated protein
  ENSP ID: ENSP00000460489
MKFVYKEEHPFEKRRSEGEKIRKKYPDRVPLVSSTS

SEQ ID NO: 33717 - protein, 27 aa, Homo sapiens
  Payload ID: 6654
  Gene Symbol: GABARAP
  Gene Name: GABA(A) receptor-associated protein
  ENSP ID: ENSP00000460855
MGQLYQEHHEEDFFLYIAYSDESVYGL

SEQ ID NO: 33718 - protein, 27 aa, Homo sapiens
  Payload ID: 6654
  Gene Symbol: GABARAP
  Gene Name: GABA(A) receptor-associated protein
  ENSP ID: ENSP00000461882
MGQLYQEHHEEDFFLYIAYSDESVYGL

SEQ ID NO: 33719 - protein, 117 aa, Homo sapiens
  Payload ID: 6655
  Gene Symbol: GABARAPL1
  Gene Name: GABA(A) receptor-associated protein like 1
  Uniprot ID: Q9H0R8
  ENSP ID: ENSP00000266458
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 33720 - protein, 146 aa, Homo sapiens
  Payload ID: 6655
  Gene Symbol: GABARAPL1
  Gene Name: GABA(A) receptor-associated protein like 1
  Uniprot ID: Q9H0R8
  ENSP ID: ENSP00000411256
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEVMVLVAQYWMPSSAVWHPLALVLDALITHLRSGAEGVIYPDPLTYGSVRL

SEQ ID NO: 33721 - protein, 10 aa, Homo sapiens
  Payload ID: 6655
  Gene Symbol: GABARAPL1
  Gene Name: GABA(A) receptor-associated protein like 1
  ENSP ID: ENSP00000437451
MGQLYEDNHE

SEQ ID NO: 33722 - protein, 43 aa, Homo sapiens
  Payload ID: 6655
  Gene Symbol: GABARAPL1
  Gene Name: GABA(A) receptor-associated protein like 1
  ENSP ID: ENSP00000438029
MKFQYKEDHPFEYRKKEGEKIRKKYPDRVPAPGLVWGQPASSC

SEQ ID NO: 33723 - protein, 27 aa, Homo sapiens
  Payload ID: 6655
  Gene Symbol: GABARAPL1
  Gene Name: GABA(A) receptor-associated protein like 1
  ENSP ID: ENSP00000439734
MGQLYEDNHEEDYFLYVAYSDESVYGK

SEQ ID NO: 33724 - protein, 36 aa, Homo sapiens
  Payload ID: 6655
  Gene Symbol: GABARAPL1
  Gene Name: GABA(A) receptor-associated protein like 1
  ENSP ID: ENSP00000441165
MKFQYKEDHPFEYRKKEGEKIRKKYPDRVPLASSTS

SEQ ID NO: 33725 - protein, 43 aa, Homo sapiens; identical to SEQ ID NO: 33722
  Payload ID: 6655
  Gene Symbol: GABARAPL1
  Gene Name: GABA(A) receptor-associated protein like 1
  ENSP ID: ENSP00000443122

SEQ ID NO: 33726 - protein, 43 aa, Homo sapiens; identical to SEQ ID NO: 33722
  Payload ID: 6655
  Gene Symbol: GABARAPL1
  Gene Name: GABA(A) receptor-associated protein like 1
  ENSP ID: ENSP00000443720

SEQ ID NO: 33727 - protein, 43 aa, Homo sapiens; identical to SEQ ID NO: 33722
  Payload ID: 6655
  Gene Symbol: GABARAPL1
  Gene Name: GABA(A) receptor-associated protein like 1
  ENSP ID: ENSP00000444055

SEQ ID NO: 33728 - protein, 70 aa, Homo sapiens
  Payload ID: 6655
  Gene Symbol: GABARAPL1
  Gene Name: GABA(A) receptor-associated protein like 1
  ENSP ID: ENSP00000444108
MKFQYKEDHPFEYRKKEGEKIRKKYPDRVPVIVEKAPKARVPDLDKRKYLVPSDLTVGQFYFLIRKRIHL

SEQ ID NO: 33729 - protein, 117 aa, Homo sapiens; identical to SEQ ID NO: 33719
  Payload ID: 6655
  Gene Symbol: GABARAPL1
  Gene Name: GABA(A) receptor-associated protein like 1
  Uniprot ID: Q9H0R8
  ENSP ID: ENSP00000444186

SEQ ID NO: 33730 - protein, 27 aa, Homo sapiens
  Payload ID: 6655
  Gene Symbol: GABARAPL1
  Gene Name: GABA(A) receptor-associated protein like 1
  ENSP ID: ENSP00000444209
MGQLYEDNHEEDYFLYVAYSDESVYGK

SEQ ID NO: 33731 - protein, 27 aa, Homo sapiens
  Payload ID: 6655
  Gene Symbol: GABARAPL1
  Gene Name: GABA(A) receptor-associated protein like 1
  ENSP ID: ENSP00000444738
MGQLYEDNHEEDYFLYVAYSDESVYGK

SEQ ID NO: 33732 - protein, 103 aa, Homo sapiens
  Payload ID: 6655
  Gene Symbol: GABARAPL1
  Gene Name: GABA(A) receptor-associated protein like 1
  ENSP ID: ENSP00000445709
MKFQYKEDHPFEYRKKEGEKIRKKYPDRVPVSVEERRGWEGKGPRGRGRVVEMASLGRPGGSGEGRFRELLNPERPSVPEPMDVQTVELLKPRMPGPRTPLQG

SEQ ID NO: 33733 - protein, 146 aa, Homo sapiens; identical to SEQ ID NO: 33720
  Payload ID: 6655
  Gene Symbol: GABARAPL1
  Gene Name: GABA(A) receptor-associated protein like 1
  Uniprot ID: Q9H0R8
  ENSP ID: ENSP00000445857

SEQ ID NO: 33734 - protein, 36 aa, Homo sapiens; identical to SEQ ID NO: 33724
  Payload ID: 6655
  Gene Symbol: GABARAPL1
  Gene Name: GABA(A) receptor-associated protein like 1
  ENSP ID: ENSP00000446297

SEQ ID NO: 33735 - protein, 27 aa, Homo sapiens
  Payload ID: 6655
  Gene Symbol: GABARAPL1
  Gene Name: GABA(A) receptor-associated protein like 1
  ENSP ID: ENSP00000446456
MGQLYEDNHEEDYFLYVAYSDESVYGK

SEQ ID NO: 33736 - protein, 43 aa, Homo sapiens; identical to SEQ ID NO: 33722
  Payload ID: 6655
  Gene Symbol: GABARAPL1
  Gene Name: GABA(A) receptor-associated protein like 1
  ENSP ID: ENSP00000486133

SEQ ID NO: 33737 - protein, 117 aa, Homo sapiens
  Payload ID: 6656
  Gene Symbol: GABARAPL2
  Gene Name: GABA(A) receptor-associated protein like 2
  Uniprot ID: P60520
  ENSP ID: ENSP00000037243
MKWMFKEDHSLEHRCVESAKIRAKYPDRVPVIVEKVSGSQIVDIDKRKYLVPSDITVAQFMWIIRKRIQLPSEKAIFLFVDKTVPQSSLTMGQLYEKEKDEDGFLYVAYSGENTFGF

SEQ ID NO: 33738 - protein, 57 aa, Homo sapiens
  Payload ID: 6656
  Gene Symbol: GABARAPL2
  Gene Name: GABA(A) receptor-associated protein like 2
  ENSP ID: ENSP00000455606
MWIIRKRIQLPSEKAIFLFVDKTVPQSSLTMGQLYEKEKDEDGFLYVAYSGENTFGF

SEQ ID NO: 33739 - protein, 88 aa, Homo sapiens
  Payload ID: 6656
  Gene Symbol: GABARAPL2
  Gene Name: GABA(A) receptor-associated protein like 2
  ENSP ID: ENSP00000456773
MKWMFKEDHSLEHRCVESAKIRAKYPDRVPVIVEKVSGSQIVDIDKRKYLVPSDITVAQFMWIIRKRIQLPSEKAIFLFVDKTVPQSR

SEQ ID NO: 33740 - protein, 42 aa, Homo sapiens
  Payload ID: 6656
  Gene Symbol: GABARAPL2
  Gene Name: GABA(A) receptor-associated protein like 2
  ENSP ID: ENSP00000457448
MKWMFKEDHSLEHRCVESAKIRAKYPDRVPPNYGTALREGKR

SEQ ID NO: 33741 - protein, 392 aa, Homo sapiens
  Payload ID: 6657
  Gene Symbol: GALK1
  Gene Name: galactokinase 1
  Uniprot ID: P51570
  ENSP ID: ENSP00000225614
MAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPAAPLPGFSAVVVSSVPLGGGLSSSASLEVATYTFLQQLCPDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 33742 - protein, 184 aa, Homo sapiens
  Payload ID: 6657
  Gene Symbol: GALK1
  Gene Name: galactokinase 1
  ENSP ID: ENSP00000464765
GMPCGIMDQFISLMGQKGHALLIDCSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 33743 - protein, 392 aa, Homo sapiens; identical to SEQ ID NO: 33741
  Payload ID: 6657
  Gene Symbol: GALK1
  Gene Name: galactokinase 1
  Uniprot ID: P51570
  ENSP ID: ENSP00000465930

SEQ ID NO: 33744 - protein, 120 aa, Homo sapiens
  Payload ID: 6657
  Gene Symbol: GALK1
  Gene Name: galactokinase 1
  ENSP ID: ENSP00000468288
MAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPEP

SEQ ID NO: 33745 - protein, 91 aa, Homo sapiens
  Payload ID: 6657
  Gene Symbol: GALK1
  Gene Name: galactokinase 1
  ENSP ID: ENSP00000468341
DEPQRLQFPLPTAQRSLEPGTPRWANYVKGVIQYYPAAPLPGFSAVVVSSVPLGGGLSSSASLEVATYTFLQQLCPALASPPHPVLQTRAQ

SEQ ID NO: 33746 - protein, 447 aa, Homo sapiens
  Payload ID: 6658
  Gene Symbol: GALK2
  Gene Name: galactokinase 2
  Uniprot ID: Q01415
  ENSP ID: ENSP00000316632
MPVLYDRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 33747 - protein, 434 aa, Homo sapiens
  Payload ID: 6658
  Gene Symbol: GALK2
  Gene Name: galactokinase 2
  ENSP ID: ENSP00000379766
MFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 33748 - protein, 434 aa, Homo sapiens; identical to SEQ ID NO: 33747
  Payload ID: 6658
  Gene Symbol: GALK2
  Gene Name: galactokinase 2
  ENSP ID: ENSP00000440312

SEQ ID NO: 33749 - protein, 209 aa, Homo sapiens
  Payload ID: 6658
  Gene Symbol: GALK2
  Gene Name: galactokinase 2
  ENSP ID: ENSP00000452614
MFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKAKLIEFSPLRATDVKLPSGAVFVIANSCVEMNKAATSHFNIRVMECRLAAKVQAKLGISLEEMLL

SEQ ID NO: 33750 - protein, 110 aa, Homo sapiens
  Payload ID: 6658
  Gene Symbol: GALK2
  Gene Name: galactokinase 2
  ENSP ID: ENSP00000452637
  MOD_RES (1)..(1): Any amino acid
XEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGASERYENNT

SEQ ID NO: 33751 - protein, 77 aa, Homo sapiens
  Payload ID: 6658
  Gene Symbol: GALK2
  Gene Name: galactokinase 2
  ENSP ID: ENSP00000452679
MFNSKFGSIPKFYVRAPGRVNIIGEHIDYCGYSVLPMAVEQDVLIAVEPVKTYALQLANTNPLYPSSGLQGSLRQRL

SEQ ID NO: 33752 - protein, 458 aa, Homo sapiens
  Payload ID: 6658
  Gene Symbol: GALK2
  Gene Name: galactokinase 2
  Uniprot ID: Q01415
  ENSP ID: ENSP00000453129
MATESPATRRVQVAEHPRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 33753 - protein, 434 aa, Homo sapiens; identical to SEQ ID NO: 33747
  Payload ID: 6658
  Gene Symbol: GALK2
  Gene Name: galactokinase 2
  ENSP ID: ENSP00000453133

SEQ ID NO: 33754 - protein, 41 aa, Homo sapiens
  Payload ID: 6658
  Gene Symbol: GALK2
  Gene Name: galactokinase 2
  ENSP ID: ENSP00000453193
MPVLYDSLECSGMISAHYNLRLLGSSDSPASASLEAGITGY

SEQ ID NO: 33755 - protein, 45 aa, Homo sapiens
  Payload ID: 6658
  Gene Symbol: GALK2
  Gene Name: galactokinase 2
  ENSP ID: ENSP00000453241
MPVLYDRWSLALSPVLEARVQVARSWLTATSASWVEVILLPPPPE

SEQ ID NO: 33756 - protein, 157 aa, Homo sapiens
  Payload ID: 6658
  Gene Symbol: GALK2
  Gene Name: galactokinase 2
  ENSP ID: ENSP00000453252
  MOD_RES (1)..(1): Any amino acid
XLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRCFGNTSQLMHLKII

SEQ ID NO: 33757 - protein, 162 aa, Homo sapiens
  Payload ID: 6658
  Gene Symbol: GALK2
  Gene Name: galactokinase 2
  ENSP ID: ENSP00000453257
CRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGALEIPASSCILR

SEQ ID NO: 33758 - protein, 49 aa, Homo sapiens
  Payload ID: 6658
  Gene Symbol: GALK2
  Gene Name: galactokinase 2
  ENSP ID: ENSP00000453457
MPVLYDRWSLALLPSLECSGMISAHYNLRLLGSSDSPASASLEAGITGY

SEQ ID NO: 33759 - protein, 77 aa, Homo sapiens; identical to SEQ ID NO: 33751
  Payload ID: 6658
  Gene Symbol: GALK2
  Gene Name: galactokinase 2
  ENSP ID: ENSP00000453652

SEQ ID NO: 33760 - protein, 101 aa, Homo sapiens
  Payload ID: 6658
  Gene Symbol: GALK2
  Gene Name: galactokinase 2
  ENSP ID: ENSP00000453844
MATESPATRRVQVAEHPRLLKLKEMFNSKFGSIPKFYVRAPGRVNIIGEHIDYCGYSVLPMAVEQDVLIAVEPVKTYALQLANTNPLYPSSGLQGSLRQRL

SEQ ID NO: 33761 - protein, 49 aa, Homo sapiens; identical to SEQ ID NO: 33758
  Payload ID: 6658
  Gene Symbol: GALK2
  Gene Name: galactokinase 2
  ENSP ID: ENSP00000453849

SEQ ID NO: 33762 - protein, 66 aa, Homo sapiens
  Payload ID: 6658
  Gene Symbol: GALK2
  Gene Name: galactokinase 2
  ENSP ID: ENSP00000453909
MFNSKFGSIPKFYVRAPGRVNIIGEHIDYCGYSVLPMAVEQDVLIAVEPVKTYALQLANTNPLYPK

SEQ ID NO: 33763 - protein, 131 aa, Homo sapiens
  Payload ID: 6658
  Gene Symbol: GALK2
  Gene Name: galactokinase 2
  ENSP ID: ENSP00000453961
MFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAG

SEQ ID NO: 33764 - protein, 80 aa, Homo sapiens
  Payload ID: 6658
  Gene Symbol: GALK2
  Gene Name: galactokinase 2
  ENSP ID: ENSP00000454123
MFNSKFGSIPKFYVRAPGRVNIIGEHIDYCGYSVLPMAVEQDVLIAVEPVKTYALQLANTNPLYPDFSTSANNIQIDKTK

SEQ ID NO: 33765 - protein, 522 aa, Homo sapiens
  Payload ID: 6659
  Gene Symbol: GALNS
  Gene Name: galactosamine (N-acetyl)-6-sulfatase
  Uniprot ID: P34059
  ENSP ID: ENSP00000268695
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 33766 - protein, 69 aa, Homo sapiens
  Payload ID: 6659
  Gene Symbol: GALNS
  Gene Name: galactosamine (N-acetyl)-6-sulfatase
  ENSP ID: ENSP00000454484
SAAGMGASGAPQPPNILLLLMDDRGRHCSQDGYPSAMASTPPTPMPETPTHRRRLWAASQTRSSSCRSF

SEQ ID NO: 33767 - protein, 116 aa, Homo sapiens
  Payload ID: 6659
  Gene Symbol: GALNS
  Gene Name: galactosamine (N-acetyl)-6-sulfatase
  ENSP ID: ENSP00000455006
MAAVVAATRWWQLLLVLSAAGMGASGAPQPPNILLLLMDDESLPPPRAAGSPRWAPVLPDGCLCPLENAERSDCFPEHALQRPGVRVLTAVAGPFSALSGISLLKILCFRISSFHF

SEQ ID NO: 33768 - protein, 170 aa, Homo sapiens
  Payload ID: 6659
  Gene Symbol: GALNS
  Gene Name: galactosamine (N-acetyl)-6-sulfatase
  ENSP ID: ENSP00000455174
MTGTASSLAARAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYAS

SEQ ID NO: 33769 - protein, 78 aa, Homo sapiens
  Payload ID: 6659
  Gene Symbol: GALNS
  Gene Name: galactosamine (N-acetyl)-6-sulfatase
  ENSP ID: ENSP00000456884
MAAVVAATRWWQLLLVLSAAGMGASGAPQPPNILLLLMDDESLPPPRAAGSPRWAPVLPDGCLCPLENAERRSGVPKV

SEQ ID NO: 33770 - protein, 51 aa, Homo sapiens
  Payload ID: 6659
  Gene Symbol: GALNS
  Gene Name: galactosamine (N-acetyl)-6-sulfatase
  ENSP ID: ENSP00000457921
SAAGMGASGAPQPPNILLLLMDDMHVFRGQLLRACRCWCQAGRRQTDTFPT

SEQ ID NO: 33771 - protein, 342 aa, Homo sapiens
  Payload ID: 6660
  Gene Symbol: GALM
  Gene Name: galactose mutarotase (aldose 1-epimerase)
  Uniprot ID: Q96C23
  ENSP ID: ENSP00000272252
MASVTRAVFGELPSGGGTVEKFQLQSDLLRVDIISWGCTITALEVKDRQGRASDVVLGFAELEGYLQKQPYFGAVIGRVANRIAKGTFKVDGKEYHLAINKEPNSLHGGVRGFDKVLWTPRVLSNGVQFSRISPDGEEGYPGELKVWVTYTLDGGELIVNYRAQASQATPVNLTNHSYFNLAGQASPNINDHEVTIEADTYLPVDETLIPTGEVAPVQGTAFDLRKPVELGKHLQDFHLNGFDHNFCLKGSKEKHFCARVHHAASGRVLEVYTTQPGVQFYTGNFLDGTLKGKNGAVYPKHSGFCLETQNWPDAVNQPRFPPVLLRPGEEYDHTTWFKFSVA

SEQ ID NO: 33772 - protein, 194 aa, Homo sapiens
  Payload ID: 6660
  Gene Symbol: GALM
  Gene Name: galactose mutarotase (aldose 1-epimerase)
  ENSP ID: ENSP00000386233
MASVTRAVFGELPSGGGTVEKFQLQSDLLRVDIISWGCTITALEVKDRQGRASDVVLGFAELEGEVAPVQGTAFDLRKPVELGKHLQDFHLNGFDHNFCLKGSKEKHFCARVHHAASGRVLEVYTTQPGVQFYTGNFLDGTLKGKNGAVYPKHSGFCLETQNWPDAVNQPRFPPVLLRPGEEYDHTTWFKFSVA

SEQ ID NO: 33773 - protein, 218 aa, Homo sapiens
  Payload ID: 6660
  Gene Symbol: GALM
  Gene Name: galactose mutarotase (aldose 1-epimerase)
  ENSP ID: ENSP00000399473
RVLSNGVQFSRISPDGEEGYPGELKVWVTYTLDGGELIVNYRAQASQATPVNLTNHSYFNLAGQASPNINDHEVTIEADTYLPVDETLIPTGEVAPVQGTAFDLRKPVELGKHLQDFHLNGFDHNFCLKGSKEKHFCARVHHAASGRVLEVYTTQPGVQFYTGNFLDGTLKGKNGAVYPKHSGFCLETQNWPDAVNQFPFQHGIIWRQRNLEDNSRIL

SEQ ID NO: 33774 - protein, 194 aa, Homo sapiens
  Payload ID: 6660
  Gene Symbol: GALM
  Gene Name: galactose mutarotase (aldose 1-epimerase)
  ENSP ID: ENSP00000409083
LLRVDIISWGCTITALEVKDRQGRASDVVLGFAELEGYLQKQPYFGAVIGRVANRIAKGTFKVDGKEYHLAINKEPNSLHGGVRGFDKVLWTPRVLSNGVQFSRISPDGEEGYPGELKVWVTYTLDGGELIVNYRAQASQATPVNLTNHSYFNLAGQASPNINDHEVTIEADTYLPVDETLIPTGGTNRRFLQG

SEQ ID NO: 33775 - protein, 379 aa, Homo sapiens
  Payload ID: 6661
  Gene Symbol: GALT
  Gene Name: galactose-1-phosphate uridylyltransferase
  Uniprot ID: P07902
  ENSP ID: ENSP00000368119
MSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 33776 - protein, 270 aa, Homo sapiens
  Payload ID: 6661
  Gene Symbol: GALT
  Gene Name: galactose-1-phosphate uridylyltransferase
  Uniprot ID: P07902
  ENSP ID: ENSP00000401956
MTLSTLCVLGPSEPTESKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 33777 - protein, 120 aa, Homo sapiens
  Payload ID: 6661
  Gene Symbol: GALT
  Gene Name: galactose-1-phosphate uridylyltransferase
  ENSP ID: ENSP00000432839
MSRSGTDPQQRQQASEADAAAATFRANDHQHIRYNPLQDEWVLVSAHRMKRPWQGQVEPQLLKTVPRHDPLNPLCPGAIRANGELCSLMPPVQDPVIIPFSKQSLLEESVRSCASTPGRM

SEQ ID NO: 33778 - protein, 90 aa, Homo sapiens
  Payload ID: 6661
  Gene Symbol: GALT
  Gene Name: galactose-1-phosphate uridylyltransferase
  ENSP ID: ENSP00000450419
MSRSGTDPQQRQQASEADAAAATFRANDHQHIRYNPLQDEWVLVSAHRMKRPWQGQVEPQLLKTVPRHDPLNPLCPGAIRANGEPILVGR

SEQ ID NO: 33779 - protein, 84 aa, Homo sapiens
  Payload ID: 6661
  Gene Symbol: GALT
  Gene Name: galactose-1-phosphate uridylyltransferase
  ENSP ID: ENSP00000450942
MSRSGTDPQQRQQASEADAAAATFRANDHQHIRYNPLQDEWVLVSAHRMKRPWQGQVEPQLLKTVPRHDPLNPLCPGAIRANGE

SEQ ID NO: 33780 - protein, 84 aa, Homo sapiens; identical to SEQ ID NO: 33779
  Payload ID: 6661
  Gene Symbol: GALT
  Gene Name: galactose-1-phosphate uridylyltransferase
  ENSP ID: ENSP00000451435

SEQ ID NO: 33781 - protein, 59 aa, Homo sapiens
  Payload ID: 6661
  Gene Symbol: GALT
  Gene Name: galactose-1-phosphate uridylyltransferase
  ENSP ID: ENSP00000451756
  MOD_RES (1)..(1): Any amino acid
XEWVLVSAHRMKRPWQGQVEPQLLKTVPRHDPLNPLCPGAIRANGEGGPSLLPCSLSSL

SEQ ID NO: 33782 - protein, 423 aa, Homo sapiens
  Payload ID: 6662
  Gene Symbol: GAL3ST1
  Gene Name: galactose-3-O-sulfotransferase 1
  Uniprot ID: Q99999
  ENSP ID: ENSP00000343234
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 33783 - protein, 423 aa, Homo sapiens; identical to SEQ ID NO: 33782
  Payload ID: 6662
  Gene Symbol: GAL3ST1
  Gene Name: galactose-3-O-sulfotransferase 1
  Uniprot ID: Q99999
  ENSP ID: ENSP00000384122

SEQ ID NO: 33784 - protein, 423 aa, Homo sapiens; identical to SEQ ID NO: 33782
  Payload ID: 6662
  Gene Symbol: GAL3ST1
  Gene Name: galactose-3-O-sulfotransferase 1
  Uniprot ID: Q99999
  ENSP ID: ENSP00000384388

SEQ ID NO: 33785 - protein, 423 aa, Homo sapiens; identical to SEQ ID NO: 33782
  Payload ID: 6662
  Gene Symbol: GAL3ST1
  Gene Name: galactose-3-O-sulfotransferase 1
  Uniprot ID: Q99999
  ENSP ID: ENSP00000385207

SEQ ID NO: 33786 - protein, 423 aa, Homo sapiens; identical to SEQ ID NO: 33782
  Payload ID: 6662
  Gene Symbol: GAL3ST1
  Gene Name: galactose-3-O-sulfotransferase 1
  Uniprot ID: Q99999
  ENSP ID: ENSP00000385735

SEQ ID NO: 33787 - protein, 423 aa, Homo sapiens; identical to SEQ ID NO: 33782
  Payload ID: 6662
  Gene Symbol: GAL3ST1
  Gene Name: galactose-3-O-sulfotransferase 1
  Uniprot ID: Q99999
  ENSP ID: ENSP00000385825

SEQ ID NO: 33788 - protein, 102 aa, Homo sapiens
  Payload ID: 6662
  Gene Symbol: GAL3ST1
  Gene Name: galactose-3-O-sulfotransferase 1
  ENSP ID: ENSP00000389876
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKH

SEQ ID NO: 33789 - protein, 71 aa, Homo sapiens
  Payload ID: 6662
  Gene Symbol: GAL3ST1
  Gene Name: galactose-3-O-sulfotransferase 1
  ENSP ID: ENSP00000390068
MLPPQKKPWESMAKGLVLGALFTSFLLLVYSYAVPPLHAGLASTTPEAAASCSPPALEPEAVIRANGSAGE

SEQ ID NO: 33790 - protein, 279 aa, Homo sapiens
  Payload ID: 6662
  Gene Symbol: GAL3ST1
  Gene Name: galactose-3-O-sulfotransferase 1
  ENSP ID: ENSP00000390545
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLN

SEQ ID NO: 33791 - protein, 170 aa, Homo sapiens
  Payload ID: 6662
  Gene Symbol: GAL3ST1
  Gene Name: galactose-3-O-sulfotransferase 1
  ENSP ID: ENSP00000391485
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLF

SEQ ID NO: 33792 - protein, 149 aa, Homo sapiens
  Payload ID: 6662
  Gene Symbol: GAL3ST1
  Gene Name: galactose-3-O-sulfotransferase 1
  ENSP ID: ENSP00000391996
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEV

SEQ ID NO: 33793 - protein, 85 aa, Homo sapiens
  Payload ID: 6662
  Gene Symbol: GAL3ST1
  Gene Name: galactose-3-O-sulfotransferase 1
  ENSP ID: ENSP00000394912
MLPPQKKPWESMAKGLVLGALFTSFLLLVYSYAVPPLHAGLASTTPEAAASCSPPALEPEAVIRANGSAGECQPRRNIVFLKTHK

SEQ ID NO: 33794 - protein, 265 aa, Homo sapiens
  Payload ID: 6662
  Gene Symbol: GAL3ST1
  Gene Name: galactose-3-O-sulfotransferase 1
  ENSP ID: ENSP00000395080
MLPPQKKPWESMAKGLVLGALFTSFLLLVYSYAVPPLHAGLASTRTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKD

SEQ ID NO: 33795 - protein, 163 aa, Homo sapiens
  Payload ID: 6662
  Gene Symbol: GAL3ST1
  Gene Name: galactose-3-O-sulfotransferase 1
  ENSP ID: ENSP00000397092
MLPPQKKPWESMAKGLVLGALFTSFLLLVYSYAVPPLHAGLASTRTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITV

SEQ ID NO: 33796 - protein, 100 aa, Homo sapiens
  Payload ID: 6662
  Gene Symbol: GAL3ST1
  Gene Name: galactose-3-O-sulfotransferase 1
  ENSP ID: ENSP00000398380
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQ

SEQ ID NO: 33797 - protein, 75 aa, Homo sapiens
  Payload ID: 6662
  Gene Symbol: GAL3ST1
  Gene Name: galactose-3-O-sulfotransferase 1
  ENSP ID: ENSP00000399649
MLPPQKKPWESMAKGLVLGALFTSFLLLVYSYAVPPLHAGLASTTPEAAASCSPPALEPEAVIRANGSAGECQPR

SEQ ID NO: 33798 - protein, 112 aa, Homo sapiens
  Payload ID: 6662
  Gene Symbol: GAL3ST1
  Gene Name: galactose-3-O-sulfotransferase 1
  ENSP ID: ENSP00000401074
MLPPQKKPWESMAKGLVLGALFTSFLLLVYSYAVPPLHAGLASTRTPEAAASCSPPALEPEAVIRANGSAGECQPRRNIVFLKTHKTASSTLLNILFRFGQKHRLKFAFPNG

SEQ ID NO: 33799 - protein, 199 aa, Homo sapiens
  Payload ID: 6662
  Gene Symbol: GAL3ST1
  Gene Name: galactose-3-O-sulfotransferase 1
  ENSP ID: ENSP00000401426
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQD

SEQ ID NO: 33800 - protein, 242 aa, Homo sapiens
  Payload ID: 6662
  Gene Symbol: GAL3ST1
  Gene Name: galactose-3-O-sulfotransferase 1
  ENSP ID: ENSP00000405017
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEV

SEQ ID NO: 33801 - protein, 143 aa, Homo sapiens
  Payload ID: 6662
  Gene Symbol: GAL3ST1
  Gene Name: galactose-3-O-sulfotransferase 1
  ENSP ID: ENSP00000405381
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMR

SEQ ID NO: 33802 - protein, 95 aa, Homo sapiens
  Payload ID: 6662
  Gene Symbol: GAL3ST1
  Gene Name: galactose-3-O-sulfotransferase 1
  ENSP ID: ENSP00000412995
MLPPQKKPWESMAKGLVLGALFTSFLLLVYSYAVPPLHAGLASTTPEAAASCSPPALEPEAVIRANGSAGECQPRRNIVFLKTHKTASSTLLNIL

SEQ ID NO: 33803 - protein, 98 aa, Homo sapiens
  Payload ID: 6662
  Gene Symbol: GAL3ST1
  Gene Name: galactose-3-O-sulfotransferase 1
  ENSP ID: ENSP00000414542
MLPPQKKPWESMAKGLVLGALFTSFLLLVYSYAVPPLHAGLASTTPEAAASCSPPALEPEAVIRANGSAGECQPRRNIVFLKTHKTASSTLLNILFRF

SEQ ID NO: 33804 - protein, 398 aa, Homo sapiens
  Payload ID: 6663
  Gene Symbol: GAL3ST2
  Gene Name: galactose-3-O-sulfotransferase 2
  Uniprot ID: Q9H3Q3
  ENSP ID: ENSP00000192314
MMSMLGGLQRYFRVILLLLLALTLLLLAGFLHSDLELDTPLFGGQAEGPPVTNIMFLKTHKTASSTVLNILYRFAETHNLSVALPAGSRVHLGYPWLFLARYVEGVGSQQRFNIMCNHLRFNLPQVQKVMPNDTFYFSILRNPVFQLESSFIYYKTYAPAFRGAPSLDAFLASPRTFYNDSRHLRNVYAKNNMWFDFGFDPNAQCEEGYVRARIAEVERRFRLVLIAEHLDESLVLLRRRLRWALDDVVAFRLNSRSARSVARLSPETRERARSWCALDWRLYEHFNRTLWAQLRAELGPRRLRGEVERLRARRRELASLCLQDGGALKNHTQIRDPRLRPYQSGKADILGYNLRPGLDNQTLGVCQRLVMPELQYMARLYALQFPEKPLKNIPFLGA

SEQ ID NO: 33805 - protein, 389 aa, Homo sapiens
  Payload ID: 6663
  Gene Symbol: GAL3ST2
  Gene Name: galactose-3-O-sulfotransferase 2
  ENSP ID: ENSP00000484626
  MOD_RES (1)..(1): Any amino acid
XYFRVILLLLLALTLLLLAGFLHSDLELDTPLFGGQAEGPPVTNIMFLKTHKTASSTVLNILYRFAETHNLSVALPAGSRVHLGYPWLFLARYVEGVGSQQRFNIMCNHLRFNLPQVQKVMPNDTFYFSILRNPVFQLESSFIYYKTYAPAFRGAPSLDAFLASPRTFYNDSRHLRNVYAKNNMWFDFGFDPNAQCEEGYVRARIAEVERRFRLVLIAEHLDESLVLLRRRLRWALDDVVAFRLNSRSARSVARLSPETRERARSWCALDWRLYEHFNRTLWAQLRAELGPRRLRGEVERLRARRRELASLCLQDGGALKNHTQIRDPRLRPYQSGKADILGYNLRPGLDNQTLGVCQRLVMPELQYMARLYALQFPEKPLKNIPFLGA

SEQ ID NO: 33806 - protein, 389 aa, Homo sapiens
  Payload ID: 6663
  Gene Symbol: GAL3ST2
  Gene Name: galactose-3-O-sulfotransferase 2
  ENSP ID: ENSP00000488118
RYFRVILLLLLALTLLLLAGFLHSDLELDTPLFGGQAEGPPVTNIMFLKTHKTASSTVLNILYRFAETHNLSVALPAGSRVHLGYPWLFLARYVEGVGSQQRFNIMCNHLRFNLPQVQKVMPNDTFYFSILRNPVFQLESSFIYYKTYAPAFRGAPSLDAFLASPRTFYNDSRHLRNVYAKNNMWFDFGFDPNAQCEEGYVRARIAEVERRFRLVLIAEHLDESLVLLRRRLRWALDDVVAFRLNSRSARSVARLSPETRERARSWCALDWRLYEHFNRTLWAQLRAELGPRRLRGEVERLRARRRELASLCLQDGGALKNHTQIRDPRLRPYQSGKADILGYNLRPGLDNQTLGVCQRLVMPELQYMARLYALQFPEKPLKNIPFLGA

SEQ ID NO: 33807 - protein, 431 aa, Homo sapiens
  Payload ID: 6664
  Gene Symbol: GAL3ST3
  Gene Name: galactose-3-O-sulfotransferase 3
  Uniprot ID: Q96A11
  ENSP ID: ENSP00000308591
MPPILQRLQQATKMMSRRKILLLVLGCSTVSLLIHQGAQLSWYPKLFPLSCPPLRNSPPRPKHMTVAFLKTHKTAGTTVQNILFRFAERHNLTVALPHPSCEHQFCYPRNFSAHFVHPATRPPHVLASHLRFDRAELERLMPPSTVYVTILREPAAMFESLFSYYNQYCPAFRRVPNASLEAFLRAPEAYYRAGEHFAMFAHNTLAYDLGGDNERSPRDDAAYLAGLIRQVEEVFSLVMIAEYFDESLVLLRRLLAWDLDDVLYAKLNARAASSRLAAIPAALARAARTWNALDAGLYDHFNATFWRHVARAGRACVEREARELREARQRLLRRCFGDEPLLRPAAQIRTKQLQPWQPSRKVDIMGYDLPGGGAGPATEACLKLAMPEVQYSNYLLRKQKRRGGARARPEPVLDNPPPRPIRVLPRGPQGP

SEQ ID NO: 33808 - protein, 431 aa, Homo sapiens; identical to SEQ ID NO: 33807
  Payload ID: 6664
  Gene Symbol: GAL3ST3
  Gene Name: galactose-3-O-sulfotransferase 3
  Uniprot ID: Q96A11
  ENSP ID: ENSP00000434829

SEQ ID NO: 33809 - protein, 486 aa, Homo sapiens
  Payload ID: 6665
  Gene Symbol: GAL3ST4
  Gene Name: galactose-3-O-sulfotransferase 4
  Uniprot ID: Q96RP7
  ENSP ID: ENSP00000353142
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAALARSAFSYYKSTSSAFRKSPSLAAFLANPRGFYRPGARGDHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDAKQFPPTVSLPLKTSRPLSP

SEQ ID NO: 33810 - protein, 220 aa, Homo sapiens
  Payload ID: 6665
  Gene Symbol: GAL3ST4
  Gene Name: galactose-3-O-sulfotransferase 4
  ENSP ID: ENSP00000399066
MGPLSPARTLRLWGPRSLGVALGVFMTIGFALQLLGGPFQRRYFRSCLLTASFFPLSETQRLWLALPSPTINPPHQPSASHHLWLPSWPILEASTGLGPVGTTTLATYYGLTLACPFPQRRGPREGIFIPPETPTPHSCRSCLLVLALEPKPSIPMPSSILFPLLLIIAARYQALPLSIWGLHPSSSGVWHGWTLSLTWSWWLSTSMSHWFCWQMPCAGV

SEQ ID NO: 33811 - protein, 486 aa, Homo sapiens; identical to SEQ ID NO: 33809
  Payload ID: 6665
  Gene Symbol: GAL3ST4
  Gene Name: galactose-3-O-sulfotransferase 4
  Uniprot ID: Q96RP7
  ENSP ID: ENSP00000400451

SEQ ID NO: 33812 - protein, 220 aa, Homo sapiens; identical to SEQ ID NO: 33810
  Payload ID: 6665
  Gene Symbol: GAL3ST4
  Gene Name: galactose-3-O-sulfotransferase 4
  ENSP ID: ENSP00000414733

SEQ ID NO: 33813 - protein, 132 aa, Homo sapiens
  Payload ID: 6665
  Gene Symbol: GAL3ST4
  Gene Name: galactose-3-O-sulfotransferase 4
  ENSP ID: ENSP00000487594
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHI

SEQ ID NO: 33814 - protein, 118 aa, Homo sapiens
  Payload ID: 6665
  Gene Symbol: GAL3ST4
  Gene Name: galactose-3-O-sulfotransferase 4
  ENSP ID: ENSP00000488586
MGPLSPARTLRLWGPRSLGVALGVFMTIGFALQLLGGPFQRRYFRSCLLTASFFPLSETQRLWLALPSPTINPPHQPSASHHLWLPSWPILEASTGLGPVGTTTLATYYGLTLACPFP

SEQ ID NO: 33815 - protein, 110 aa, Homo sapiens
  Payload ID: 6665
  Gene Symbol: GAL3ST4
  Gene Name: galactose-3-O-sulfotransferase 4
  ENSP ID: ENSP00000488800
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKL

SEQ ID NO: 33816 - protein, 429 aa, Homo sapiens
  Payload ID: 6666
  Gene Symbol: GLA
  Gene Name: galactosidase, alpha
  Uniprot ID: P06280
  ENSP ID: ENSP00000218516
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 33817 - protein, 222 aa, Homo sapiens
  Payload ID: 6666
  Gene Symbol: GLA
  Gene Name: galactosidase, alpha
  ENSP ID: ENSP00000476935
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKSSTLFGSIC

SEQ ID NO: 33818 - protein, 546 aa, Homo sapiens
  Payload ID: 6667
  Gene Symbol: GLB1
  Gene Name: galactosidase, beta 1
  ENSP ID: ENSP00000305920
MPGFLVRILPLLLVLLLLGPTRGLRNATQRMFEIDYSRDSFLKDGQPFRYISGSIHYSRVPRFYWKDRLLKMKMAGLNAIQTLPGSCGQVVGSPSAQDEASPLSEWRASYNSAGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 33819 - protein, 677 aa, Homo sapiens
  Payload ID: 6667
  Gene Symbol: GLB1
  Gene Name: galactosidase, beta 1
  Uniprot ID: P16278
  ENSP ID: ENSP00000306920
MPGFLVRILPLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 33820 - protein, 647 aa, Homo sapiens
  Payload ID: 6667
  Gene Symbol: GLB1
  Gene Name: galactosidase, beta 1
  Uniprot ID: P16278
  ENSP ID: ENSP00000382333
MFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 33821 - protein, 147 aa, Homo sapiens
  Payload ID: 6667
  Gene Symbol: GLB1
  Gene Name: galactosidase, beta 1
  ENSP ID: ENSP00000387989
MPGFLVRILPLLLVLLLLGPTRGLRSRFLPWAFHLPRQAPKSQLPLHKRGTKTAPNEHASSNRSGRRRRRQQWNATQRMFEIDYSRDSFLKDGQPFRYISGSIHYSRVPRFYWKDRLLKMKMAGLNAIQTYVPWNFHEPWPGQYQFS

SEQ ID NO: 33822 - protein, 41 aa, Homo sapiens
  Payload ID: 6667
  Gene Symbol: GLB1
  Gene Name: galactosidase, beta 1
  ENSP ID: ENSP00000401250
MPGFLVRILPLLLVLLLLGPTRGLRITWQLWTSGWESFCPR

SEQ ID NO: 33823 - protein, 102 aa, Homo sapiens
  Payload ID: 6667
  Gene Symbol: GLB1
  Gene Name: galactosidase, beta 1
  ENSP ID: ENSP00000403264
MFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEM

SEQ ID NO: 33824 - protein, 84 aa, Homo sapiens
  Payload ID: 6667
  Gene Symbol: GLB1
  Gene Name: galactosidase, beta 1
  ENSP ID: ENSP00000407365
MFEIDYSRDSFLKDGQPFRYISGSIHYSRVPRFYWKDRLLKMKMAGLNAIQTLPGSCGQVVGSPSAQDEASPLSEWRASYNSAG

SEQ ID NO: 33825 - protein, 114 aa, Homo sapiens
  Payload ID: 6667
  Gene Symbol: GLB1
  Gene Name: galactosidase, beta 1
  ENSP ID: ENSP00000411769
MGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTG

SEQ ID NO: 33826 - protein, 185 aa, Homo sapiens
  Payload ID: 6667
  Gene Symbol: GLB1
  Gene Name: galactosidase, beta 1
  ENSP ID: ENSP00000411813
MPGFLVRILPLLLVLLLLGPTRGLRVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLT

SEQ ID NO: 33827 - protein, 654 aa, Homo sapiens
  Payload ID: 6668
  Gene Symbol: GLB1L
  Gene Name: galactosidase, beta 1-like
  Uniprot ID: Q6UWU2
  ENSP ID: ENSP00000295759
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANLLVILRPGPYICAEWEMGGLPSWLLRKPEIHLRTSDPDFLAAVDSWFKVLLPKIYPWLYHNGGNIISIQVENEYGSYRACDFSYMRHLAGLFRALLGEKILLFTTDGPEGLKCGSLRGLYTTVDFGPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 33828 - protein, 654 aa, Homo sapiens; identical to SEQ ID NO: 33827
  Payload ID: 6668
  Gene Symbol: GLB1L
  Gene Name: galactosidase, beta 1-like
  Uniprot ID: Q6UWU2
  ENSP ID: ENSP00000375939

SEQ ID NO: 33829 - protein, 564 aa, Homo sapiens
  Payload ID: 6668
  Gene Symbol: GLB1L
  Gene Name: galactosidase, beta 1-like
  Uniprot ID: Q6UWU2
  ENSP ID: ENSP00000386354
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANLLVILRPGPYICAEWEMGGLPSWLLRKPEIHLRTSDPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 33830 - protein, 185 aa, Homo sapiens
  Payload ID: 6668
  Gene Symbol: GLB1L
  Gene Name: galactosidase, beta 1-like
  ENSP ID: ENSP00000387703
  MOD_RES (1)..(1): Any amino acid
XKMRWSGLNAIQFYVPWNYHEPQPGVYNFNGSRDLIAFLNEAALANLLVILRPGPYICAEWEMGGLPSWLLRKPEIHLRTSDPDFLAAVDSWFKVLLPKIYPWLYHNGGNIISIQVENEYGSYRACDFSYMRHLAGLFRALLGEKILLFTTDGPEGLKCGSLRGLYTTVDFGPGLKQGLGVESGE

SEQ ID NO: 33831 - protein, 9 aa, Homo sapiens
  Payload ID: 6668
  Gene Symbol: GLB1L
  Gene Name: galactosidase, beta 1-like
  ENSP ID: ENSP00000392018
MAPKKLSCL

SEQ ID NO: 33832 - protein, 50 aa, Homo sapiens
  Payload ID: 6668
  Gene Symbol: GLB1L
  Gene Name: galactosidase, beta 1-like
  ENSP ID: ENSP00000396263
MAPKKLSCLRSLLLPLSLTLLLPQTGPRSAMCLAACTTFGYRGCFGPTGF

SEQ ID NO: 33833 - protein, 114 aa, Homo sapiens
  Payload ID: 6668
  Gene Symbol: GLB1L
  Gene Name: galactosidase, beta 1-like
  ENSP ID: ENSP00000400738
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANL

SEQ ID NO: 33834 - protein, 26 aa, Homo sapiens
  Payload ID: 6668
  Gene Symbol: GLB1L
  Gene Name: galactosidase, beta 1-like
  ENSP ID: ENSP00000404698
MAPKKLSCLRSLLLPLSLTLLLPQAD

SEQ ID NO: 33835 - protein, 636 aa, Homo sapiens
  Payload ID: 6669
  Gene Symbol: GLB1L2
  Gene Name: galactosidase, beta 1-like 2
  Uniprot ID: Q8IW92
  ENSP ID: ENSP00000344659
MTTWSLRRRPARTLGLLLLVVLGFLVLRRLDWSTLVPLRLRHRQLGLQAKGWNFMLEDSTFWIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGIPLPPPPDLLPKMPYEPLTPVLYLSLWDALKYLGEPIKSEKPINMENLPVNGGNGQSFGYILYETSITSSGILSGHVHDRGQVFVNTVSIGFLDYKTTKIAVPLIQGYTVLRILVENRGRVNYGENIDDQRKGLIGNLYLNDSPLKNFRIYSLDMKKSFFQRFGLDKWSSLPETPTLPAFFLGSLSISSTPCDTFLKLEGWEKGVVFINGQNLGRYWNIGPQKTLYLPGPWLSSGINQVIVFEETMAGPALQFTETPHLGRNQYIK

SEQ ID NO: 33836 - protein, 636 aa, Homo sapiens; identical to SEQ ID NO: 33835
  Payload ID: 6669
  Gene Symbol: GLB1L2
  Gene Name: galactosidase, beta 1-like 2
  Uniprot ID: Q8IW92
  ENSP ID: ENSP00000444628

SEQ ID NO: 33837 - protein, 313 aa, Homo sapiens
  Payload ID: 6670
  Gene Symbol: GLB1L3
  Gene Name: galactosidase, beta 1-like 3
  Uniprot ID: Q8NCI6
  ENSP ID: ENSP00000374537
MKSPPLLSPCLSWKRMAGIFFLPFISSGFAPRFKQEENFMLGRAHPSQPRFNWSHLTPLELKNRSVGLGTESTGRGKPHFTLEGHKFLIFGGSIHYFRVPREYWRDRLLKLKACGFNTVTTYVPWNLHEPERGKFDFSGNLDLEAFVLMAAEIGLWVILRPGRYICSEMDLGGLPSWLLQDPRLLLRTTNKSFIEAVEKYFDHLIPRVIPLQYRQAGPVIAVQVENEYGSFNKDKTYMPYLHKALLRRGIVELLLTSDGEKHVLSGHTKGVLAAINLQKLHQDTFNQLHKVQGASIDAGLLSDASQAATSSSL

SEQ ID NO: 33838 - protein, 653 aa, Homo sapiens
  Payload ID: 6670
  Gene Symbol: GLB1L3
  Gene Name: galactosidase, beta 1-like 3
  Uniprot ID: Q8NCI6
  ENSP ID: ENSP00000396615
MKSPPLLSPCLSWKRMAGIFFLPFISSGFAPRFKQEENFMLGRAHPSQPRFNWSHLTPLELKNRSVGLGTESTGRGKPHFTLEGHKFLIFGGSIHYFRVPREYWRDRLLKLKACGFNTVTTYVPWNLHEPERGKFDFSGNLDLEAFVLMAAEIGLWVILRPGRYICSEMDLGGLPSWLLQDPRLLLRTTNKSFIEAVEKYFDHLIPRVIPLQYRQAGPVIAVQVENEYGSFNKDKTYMPYLHKALLRRGIVELLLTSDGEKHVLSGHTKGVLAAINLQKLHQDTFNQLHKVQRDKPLLIMEYWVGWFDRWGDKHHVKDAKEVEHAVSEFIKYEISFNVYMFHGGTNFGFMNGATYFGKHSGIVTSYDYDAVLTEAGDYTEKYLKLQKLFQSVSATPLPRVPKLPPKAVYPPVRPSLYLPLWDALSYLNEPVRSRQPVNMENLPINNGSGQSYGLVLYEKSICSGGRLRAHAHDVAQVFLDETMIGILNENNKDLHIPELRDCRYLRILVENQGRVNFSWQIQNEQKGITGSVSINNSSLEGFTIYSLEMKMSFFERLRSATWKPVPDSHQGPAFYCGTLKAGPSPKDTFLSLLNWNYGFVFINGRNLGRYWNIGPQKTLYLPGVWLHPEDNEVILFEKMMSGSDIKSTDKPTL

SEQ ID NO: 33839 - protein, 186 aa, Homo sapiens
  Payload ID: 6670
  Gene Symbol: GLB1L3
  Gene Name: galactosidase, beta 1-like 3
  ENSP ID: ENSP00000397929
  MOD_RES (1)..(1): Any amino acid
XLKMQRVEHAVSEFIKYEISFNVYMFHGGTNFGFMNGATYFGKHSGIVTSYDYDAVLTEAGDYTEKYLKLQKLFQSVSATPLPRVPKLPPKAVYPPVRPSLYLPLWDALSYLNEPVRSRQPVNMENLPINNGSGQSYGLVLYEKSICSGGRLRAHAHDVAQVFLDETMIGILNENNKDLHIPELRE

SEQ ID NO: 33840 - protein, 685 aa, Homo sapiens
  Payload ID: 6671
  Gene Symbol: GALC
  Gene Name: galactosylceramidase
  ENSP ID: ENSP00000261304
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 33841 - protein, 662 aa, Homo sapiens
  Payload ID: 6671
  Gene Symbol: GALC
  Gene Name: galactosylceramidase
  ENSP ID: ENSP00000377198
MAEWLLSASWQRRAKAMTAAAGSAGRAAVPLLLCALLAPGGAYVLDDSDGLGREFDGIGAVSGGGPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 33842 - protein, 659 aa, Homo sapiens
  Payload ID: 6671
  Gene Symbol: GALC
  Gene Name: galactosylceramidase
  ENSP ID: ENSP00000377199
MLGKSHGRATHGPLPLADLGIHLPCVKVLHQVTPEEKPAATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 33843 - protein, 589 aa, Homo sapiens
  Payload ID: 6671
  Gene Symbol: GALC
  Gene Name: galactosylceramidase
  Uniprot ID: P54803
  ENSP ID: ENSP00000437513
MGFMVADLWATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKVAGRRKKT

SEQ ID NO: 33844 - protein, 434 aa, Homo sapiens
  Payload ID: 6671
  Gene Symbol: GALC
  Gene Name: galactosylceramidase
  ENSP ID: ENSP00000450472
MLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKVAGRRKKT

SEQ ID NO: 33845 - protein, 72 aa, Homo sapiens
  Payload ID: 6671
  Gene Symbol: GALC
  Gene Name: galactosylceramidase
  ENSP ID: ENSP00000451480
  MOD_RES (1)..(1): Any amino acid
XKLGKTSERFLFKQLDSLWLLDSDGSFTLSLHEDELFTLTTLTTGRKGSYPLPPKSQPFPSTYKDDFNVGPI

SEQ ID NO: 33846 - protein, 112 aa, Homo sapiens
  Payload ID: 6671
  Gene Symbol: GALC
  Gene Name: galactosylceramidase
  ENSP ID: ENSP00000451884
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDIL

SEQ ID NO: 33847 - protein, 62 aa, Homo sapiens
  Payload ID: 6671
  Gene Symbol: GALC
  Gene Name: galactosylceramidase
  ENSP ID: ENSP00000452208
KAMTAAAGSAGRAAVPLLLCALLAPGGAYVLDDSDGLGREFDGIGAVSGGGDWCLKVSLKGR

SEQ ID NO: 33848 - protein, 211 aa, Homo sapiens
  Payload ID: 6671
  Gene Symbol: GALC
  Gene Name: galactosylceramidase
  ENSP ID: ENSP00000452314
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKVFGE

SEQ ID NO: 33849 - protein, 404 aa, Homo sapiens
  Payload ID: 6671
  Gene Symbol: GALC
  Gene Name: galactosylceramidase
  ENSP ID: ENSP00000480649
  MOD_RES (1)..(1): Any amino acid
XLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMVNFCCCYWINSLLYYWKNKI

SEQ ID NO: 33850 - protein, 349 aa, Homo sapiens
  Payload ID: 6672
  Gene Symbol: GALR1
  Gene Name: galanin receptor 1
  Uniprot ID: P47211
  ENSP ID: ENSP00000299727
MELAVGNLSEGNASWPEPPAPEPGPLFGIGVENFVTLVVFGLIFALGVLGNSLVITVLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGCIWALSIAMASPVAYHQGLFHPRASNQTFCWEQWPDPRHKKAYVVCTFVFGYLLPLLLICFCYAKVLNHLHKKLKNMSKKSEASKKKTAQTVLVVVVVFGISWLPHHIIHLWAEFGVFPLTPASFLFRITAHCLAYSNSSVNPIIYAFLSENFRKAYKQVFKCHIRKDSHLSDTKESKSRIDTPPSTNCTHV

SEQ ID NO: 33851 - protein, 387 aa, Homo sapiens
  Payload ID: 6673
  Gene Symbol: GALR2
  Gene Name: galanin receptor 2
  Uniprot ID: O43603
  ENSP ID: ENSP00000329684
MNVSGCPGAGNASQAGGGGGWHPEAVIVPLLFALIFLVGTVGNTLVLAVLLRGGQAVSTTNLFILNLGVADLCFILCCVPFQATIYTLDGWVFGSLLCKAVHFLIFLTMHASSFTLAAVSLDRYLAIRYPLHSRELRTPRNALAAIGLIWGLSLLFSGPYLSYYRQSQLANLTVCHPAWSAPRRRAMDICTFVFSYLLPVLVLGLTYARTLRYLWRAVDPVAAGSGARRAKRKVTRMILIVAALFCLCWMPHHALILCVWFGQFPLTRATYALRILSHLVSYANSCVNPIVYALVSKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 33852 - protein, 368 aa, Homo sapiens
  Payload ID: 6674
  Gene Symbol: GALR3
  Gene Name: galanin receptor 3
  Uniprot ID: O60755
  ENSP ID: ENSP00000249041
MADAQNISLDSPGSVGAVAVPVVFALIFLLGTVGNGLVLAVLLQPGPSAWQEPGSTTDLFILNLAVADLCFILCCVPFQATIYTLDAWLFGALVCKAVHLLIYLTMYASSFTLAAVSVDRYLAVRHPLRSRALRTPRNARAAVGLVWLLAALFSAPYLSYYGTVRYGALELCVPAWEDARRRALDVATFAAGYLLPVAVVSLAYGRTLRFLWAAVGPAGAAAAEARRRATGRAGRAMLAVAALYALCWGPHHALILCFWYGRFAFSPATYACRLASHCLAYANSCLNPLVYALASRHFRARFRRLWPCGRRRRHRARRALRRVRPASSGPPGCPGDARPSGRLLAGGGQGPEPREGPVHGGEAARGPE

SEQ ID NO: 33853 - protein, 123 aa, Homo sapiens
  Payload ID: 6675
  Gene Symbol: GAL
  Gene Name: galanin/GMAP prepropeptide
  Uniprot ID: P22466
  ENSP ID: ENSP00000265643
MARGSALLLASLLLAAALSASAGLWSPAKEKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 33854 - protein, 116 aa, Homo sapiens
  Payload ID: 6676
  Gene Symbol: GALP
  Gene Name: galanin-like peptide
  Uniprot ID: Q9UBC7
  ENSP ID: ENSP00000349884
MAPPSVPLVLLLVLLLSLAETPASAPAHRGRGGWTLNSAGYLLGPVLHLPQMGDQDGKRETALEILDLWKAIDGLPYSHPPQPSKRNVMETFAKPEIGDLGMLSMKIPKEEDVLKS

SEQ ID NO: 33855 - protein, 49 aa, Homo sapiens
  Payload ID: 6676
  Gene Symbol: GALP
  Gene Name: galanin-like peptide
  Uniprot ID: Q9UBC7
  ENSP ID: ENSP00000411521
MAPPSVPLVLLLVLLLSLAETPASAPAHRSSTFPKWVTKTERGRQPLRS

SEQ ID NO: 33856 - protein, 49 aa, Homo sapiens; identical to SEQ ID NO: 33855
  Payload ID: 6676
  Gene Symbol: GALP
  Gene Name: galanin-like peptide
  Uniprot ID: Q9UBC7
  ENSP ID: ENSP00000464698

SEQ ID NO: 33857 - protein, 144 aa, Homo sapiens
  Payload ID: 6677
  Gene Symbol: GRIFIN
  Gene Name: galectin-related inter-fiber protein
  Uniprot ID: A4D1Z8
  ENSP ID: ENSP00000481185
MAVQSKAFCAGGLAPGWKLLVQGHADSGEDRFETNFLLETGDIAFHIKPRFSSATVVGNAFQYGRWGPEQVSSIFPLAPGEPFEIEVSWDAEHFHVYAPEHKVLQFPCRQRPLGATTRVRVLSDHCLAQVELAKRGLSWGDRGY

SEQ ID NO: 33858 - protein, 167 aa, Homo sapiens
  Payload ID: 6678
  Gene Symbol: GTSF1
  Gene Name: gametocyte specific factor 1
  Uniprot ID: Q8WW33
  ENSP ID: ENSP00000304185
MEETYTDSLDPEKLLQCPYDKNHQIRACRFPYHLIKCRKNHPDVASKLATCPFNARHQVPRAEISHHISSCDDRSCIEQDVVNQTRSLRQETLAESTWQCPPCDEDWDKDLWEQTSTPFVWGTTHYSDNNSPASNIVTEHKNNLASGMRVPKSLPYVLPWKNNGNAQ

SEQ ID NO: 33859 - protein, 167 aa, Homo sapiens; identical to SEQ ID NO: 33858
  Payload ID: 6678
  Gene Symbol: GTSF1
  Gene Name: gametocyte specific factor 1
  Uniprot ID: Q8WW33
  ENSP ID: ENSP00000446485

SEQ ID NO: 33860 - protein, 176 aa, Homo sapiens
  Payload ID: 6678
  Gene Symbol: GTSF1
  Gene Name: gametocyte specific factor 1
  ENSP ID: ENSP00000446918
MEETYTDSLDPEKLLQCPYDKNHQIRACRFPYHLIKCRKNHPDVASKLATCPFNARHQVPRAEISHHISSCDDRSCIEQDVVNQTRSLRQETLAESTWQCPPCDEDWDKDLWEQTSTPFVWGTTHYSDNNSPASNIVTEHKNNLASGMRVPKSLPYVLPWKNNSDSLDFSLCYCLS

SEQ ID NO: 33861 - protein, 176 aa, Homo sapiens; identical to SEQ ID NO: 33860
  Payload ID: 6678
  Gene Symbol: GTSF1
  Gene Name: gametocyte specific factor 1
  ENSP ID: ENSP00000487405

SEQ ID NO: 33862 - protein, 148 aa, Homo sapiens
  Payload ID: 6679
  Gene Symbol: GTSF1L
  Gene Name: gametocyte specific factor 1-like
  Uniprot ID: Q9H1H1
  ENSP ID: ENSP00000362094
MEPEAFEICPYDPHHRIPLSRFQYHLASCRRKNPKKAKKMATCKYNACHVVPIKNLEEHEAVCVNRSAVEEEDTENPLKVSPPSSEQNDDTQQVSPCLPSPDIWNVDGANCQHVFVLKTFFPQKVVCENDTKESARETSPQKILRPGQ

SEQ ID NO: 33863 - protein, 123 aa, Homo sapiens
  Payload ID: 6679
  Gene Symbol: GTSF1L
  Gene Name: gametocyte specific factor 1-like
  Uniprot ID: Q9H1H1
  ENSP ID: ENSP00000362096
MEPEAFEICPYDPHHRIPLSRFQYHLASCRRKNPKKAKKMATCKYNACHVVPIKNLEEHEAVCVNRSAVEEEDTENPLKVSPPSSEQNDDTQQTFFPQKVVCENDTKESARETSPQKILRPGQ

SEQ ID NO: 33864 - protein, 652 aa, Homo sapiens
  Payload ID: 6680
  Gene Symbol: GGN
  Gene Name: gametogenetin
  Uniprot ID: Q86UU5
  ENSP ID: ENSP00000334940
MGNLQSEPSAGGGSRKVQPSDRAPDSRRTSLVEPEMTSQAMRLTRGLGVWFPGSATPPGLMVPREPQASPSTLPLTLERPSPVMPPPEEAAAVSAPPPAPAGTLLPGPSKWQKPAGTPVPRIRRLLEASHRGQGDPPSLRPLKPPPPPRQLSVKDTVPRAPSQFPPPLETWKPPPPLPSERQPADRRITPALATPASPPTESQAGPRNQGQTAGRARGGAPPHAGEGEMAQPADSESGLSLLCKITFKSRPSLAPPAASSSLAAKASLGGGGGGGLFAASGAISYAEVLKQGPLPPGAARPLGEVSRGAQEAEGGDGDGEGCSGPPSAPASQARALPPPPYTTFPGSKPKFDWVSAPDGPERHFRFNGAGGGIGAPRRRAAALSGPWGSPPPPPEQIHSAPGPRRPAPALLAPPTFIFPAPTNGEPMRPGPPGLQELPPLPPPTPPPTLQPPALQPTPLPVAPPLTPGLGHKESALAPTAAPALPPALAADQAPAPSPAPAPTVAEPSPPVSAPAPAAAPIKTRTRRNKGSRAARGATRKDGLHGDGPRERATATVPDSSGGGGGGSGASQTGAANTRAARHWLPFQVLNSCPCKCYCHHQPRHRRLPRNVSAWLSTSTNHLGEPPWVATIKLSGSLVAKLEHYDLQATHSN

SEQ ID NO: 33865 - protein, 59 aa, Homo sapiens
  Payload ID: 6680
  Gene Symbol: GGN
  Gene Name: gametogenetin
  ENSP ID: ENSP00000465186
MGNLQSEPSAGGGSRKVQPSDRAPDSRRTSLVEPEMTSQAMRLTRGLGVWFPGSATPPG

SEQ ID NO: 33866 - protein, 82 aa, Homo sapiens
  Payload ID: 6680
  Gene Symbol: GGN
  Gene Name: gametogenetin
  ENSP ID: ENSP00000467084
MPPPEEAAAVSAPPPAPAGTLLPGPSKWQKPAGTPVPRIRRLLEASHRGQGDPPSLRPLKPPPPPRQLSVKDTVPRAPSQFP

SEQ ID NO: 33867 - protein, 457 aa, Homo sapiens
  Payload ID: 6680
  Gene Symbol: GGN
  Gene Name: gametogenetin
  Uniprot ID: Q86UU5
  ENSP ID: ENSP00000467295
MPPPEEAAAVSAPPPAPAGTLLPGPSKWQKPAGTPVPRIRRLLEASHRGQGDPPSLRPLKPPPPPRQLSVKDTVPRAPSQFPPPLETWKPPPPLPSERQPADRRITPALATPASPPTESQAGPRNQGQTAGRARGGAPPHAGEGEMAQPADSESGLSLLCKITFKSRPSLAPPAASSSLAAKASLGGGGGGGLFAASGAISYAEVLKQGPLPPGAARPLGEVSRGAQEAEGGDGDGEGCSGPPSAPASQARALPPPPYTTFPGSKPKFDWVSAPDGPERHFRFNGAGGGIGAPRRRAAALSGPWGSPPPPPEQIHSAPGPRRPAPALLAPPTFIFPAPTNGEPMRPGPPGLQELPPLPPPTPPPTLQPPALQPTPLPVAPPLTPGLGHKESALAPTAAPALPPALAADQAPAPSPAPAPTVAEPSPPVSAPAPAAAPIKTRTRRNKGSRAARGATRA

SEQ ID NO: 33868 - protein, 697 aa, Homo sapiens
  Payload ID: 6681
  Gene Symbol: GGNBP2
  Gene Name: gametogenetin binding protein 2
  Uniprot ID: Q9H3C7
  ENSP ID: ENSP00000478220
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHGSKLNDMIDAIPKSKKNKRCQLHSLDTHKPKPLGGCWMDVWELMSQECRDEVVLIDSSCLLETLETYLRKHRFCTDCKNKVLRAYNILIGELDCSKEKGYCAALYEGLRCCPHERHIHVCCETDFIAHLLGRAEPEFAGGRRERHAKTIDIAQEEVLTCLGIHLYERLHRIWQKLRAEEQTWQMLFYLGVDALRKSFEMTVEKVQGISRLEQLCEEFSEEERVRELKQEKKRQKRKNRRKNKCVCDIPTPLQTADEKEVSQEKETDFIENSSCKACGSTEDGNTCVEVIVTNENTSCTCPSSGNLLGSPKIKKGLSPHCNGSDCGYSSSMEGSETGSREGSDVACTEGICNHDEHGDDSCVHHCEDKEDDGDSCVECWANSEENDTKGKNKKKKKKSKILKCDEHIQKLGSCITDPGNRETSGNTMHTVFHRDKTKDTHPESCCSSEKGGQPLPWFEHRKNVPQFAEPTETLFGPDSGKGAKSLVELLDESECTSDEEIFISQDEIQSFMANNQSFYSNREQYRQHLKEKFNKYCRLNDHKRPICSGWLTTAGAN

SEQ ID NO: 33869 - protein, 697 aa, Homo sapiens; identical to SEQ ID NO: 33868
  Payload ID: 6681
  Gene Symbol: GGNBP2
  Gene Name: gametogenetin binding protein 2
  Uniprot ID: Q9H3C7
  ENSP ID: ENSP00000478954

SEQ ID NO: 33870 - protein, 68 aa, Homo sapiens
  Payload ID: 6681
  Gene Symbol: GGNBP2
  Gene Name: gametogenetin binding protein 2
  ENSP ID: ENSP00000483332
MARLVAVCRDGEEEFPFERRQIPLYIDDTLTVSGPGRAGPAAPLAAVSPPPPPPGRALRTGERVCCNS

SEQ ID NO: 33871 - protein, 158 aa, Homo sapiens
  Payload ID: 6681
  Gene Symbol: GGNBP2
  Gene Name: gametogenetin binding protein 2
  ENSP ID: ENSP00000484094
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHGSKLNDMIDAIPKSKK

SEQ ID NO: 33872 - protein, 133 aa, Homo sapiens
  Payload ID: 6681
  Gene Symbol: GGNBP2
  Gene Name: gametogenetin binding protein 2
  ENSP ID: ENSP00000484329
  MOD_RES (1)..(1): Any amino acid
XDTKGKNKKKKKKSKILKCDEHIQKLGSCITDPGNRETSGNTMHTVFHRDKTKDTHPESCCSSEKGGQPLPWFEHRKNVPQFAEPTETLFGPDSGKGAKSLVELLVSIPCGLTVHNCLGTGWMWEGIVFEGLR

SEQ ID NO: 33873 - protein, 133 aa, Homo sapiens; identical to SEQ ID NO: 33872
  Payload ID: 6681
  Gene Symbol: GGNBP2
  Gene Name: gametogenetin binding protein 2
  ENSP ID: ENSP00000487803
  MOD_RES (1)..(1): Any amino acid

SEQ ID NO: 33874 - protein, 158 aa, Homo sapiens; identical to SEQ ID NO: 33871
  Payload ID: 6681
  Gene Symbol: GGNBP2
  Gene Name: gametogenetin binding protein 2
  ENSP ID: ENSP00000487906

SEQ ID NO: 33875 - protein, 68 aa, Homo sapiens; identical to SEQ ID NO: 33870
  Payload ID: 6681
  Gene Symbol: GGNBP2
  Gene Name: gametogenetin binding protein 2
  ENSP ID: ENSP00000488752

SEQ ID NO: 33876 - protein, 456 aa, Homo sapiens
  Payload ID: 6682
  Gene Symbol: GABRA1
  Gene Name: gamma-aminobutyric acid (GABA) A receptor, alpha 1
  Uniprot ID: P14867
  ENSP ID: ENSP00000023897
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSVSKIDRLSRIAFPLLFGIFNLVYWATYLNREPQLKAPTPHQ

SEQ ID NO: 33877 - protein, 456 aa, Homo sapiens; identical to SEQ ID NO: 33876
  Payload ID: 6682
  Gene Symbol: GABRA1
  Gene Name: gamma-aminobutyric acid (GABA) A receptor, alpha 1
  Uniprot ID: P14867
  ENSP ID: ENSP00000377517

SEQ ID NO: 33878 - protein, 456 aa, Homo sapiens; identical to SEQ ID NO: 33876
  Payload ID: 6682
  Gene Symbol: GABRA1
  Gene Name: gamma-aminobutyric acid (GABA) A receptor, alpha 1
  Uniprot ID: P14867
  ENSP ID: ENSP00000393097

SEQ ID NO: 33879 - protein, 456 aa, Homo sapiens; identical to SEQ ID NO: 33876
  Payload ID: 6682
  Gene Symbol: GABRA1
  Gene Name: gamma-aminobutyric acid (GABA) A receptor, alpha 1
  Uniprot ID: P14867
  ENSP ID: ENSP00000415441

SEQ ID NO: 33880 - protein, 168 aa, Homo sapiens
  Payload ID: 6682
  Gene Symbol: GABRA1
  Gene Name: gamma-aminobutyric acid (GABA) A receptor, alpha 1
  ENSP ID: ENSP00000430435
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPM

SEQ ID NO: 33881 - protein, 113 aa, Homo sapiens
  Payload ID: 6682
  Gene Symbol: GABRA1
  Gene Name: gamma-aminobutyric acid (GABA) A receptor, alpha 1
  ENSP ID: ENSP00000430507
MVQVSIASNEVSYPSELLQPAMRKSPGLSDCLWAWILLLSTLTGRSYGQPSLQDELKDNTTVFTRILDRLLDGYDNRLRPGLGERVTEVKTDIFVTSFGPVSDHDMEYTIDVF

SEQ ID NO: 33882 - protein, 91 aa, Homo sapiens
  Payload ID: 6682
  Gene Symbol: GABRA1
  Gene Name: gamma-aminobutyric acid (GABA) A receptor, alpha 1
  ENSP ID: ENSP00000430895
MLLQPAMRKSPGLSDCLWAWILLLSTLTGRSYGQPSLQDELKDNTTVFTRILDRLLDGYDNRLRPGLGERVTEVKTDIFVTSFGPVSDHDM

SEQ ID NO: 33883 - protein, 35 aa, Homo sapiens
  Payload ID: 6682
  Gene Symbol: GABRA1
  Gene Name: gamma-aminobutyric acid (GABA) A receptor, alpha 1
  ENSP ID: ENSP00000489033
MRKSPGLSDCLWAWILLLSTLTGRSYGQPSLQDEL

SEQ ID NO: 33884 - protein, 285 aa, Homo sapiens
  Payload ID: 6682
  Gene Symbol: GABRA1
  Gene Name: gamma-aminobutyric acid (GABA) A receptor, alpha 1
  ENSP ID: ENSP00000489434
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVF

SEQ ID NO: 33885 - protein, 451 aa, Homo sapiens
  Payload ID: 6683
  Gene Symbol: GABRA2
  Gene Name: gamma-aminobutyric acid (GABA) A receptor, alpha 2
  Uniprot ID: P47869
  ENSP ID: ENSP00000348897
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 33886 - protein, 451 aa, Homo sapiens; identical to SEQ ID NO: 33885
  Payload ID: 6683
  Gene Symbol: GABRA2
  Gene Name: gamma-aminobutyric acid (GABA) A receptor, alpha 2
  Uniprot ID: P47869
  ENSP ID: ENSP00000371033

SEQ ID NO: 33887 - protein, 451 aa, Homo sapiens; identical to SEQ ID NO: 33885
  Payload ID: 6683
  Gene Symbol: GABRA2
  Gene Name: gamma-aminobutyric acid (GABA) A receptor, alpha 2
  Uniprot ID: P47869
  ENSP ID: ENSP00000421300

SEQ ID NO: 33888 - protein, 66 aa, Homo sapiens
  Payload ID: 6683
  Gene Symbol: GABRA2
  Gene Name: gamma-aminobutyric acid (GABA) A receptor, alpha 2
  ENSP ID: ENSP00000421639
MKTKLNIYNMQFLLFVFLVWDPARLVLANIQEDEAKNNITIFTRILDRLLDGYDNRLRPGLGGIYN

SEQ ID NO: 33889 - protein, 451 aa, Homo sapiens; identical to SEQ ID NO: 33885
  Payload ID: 6683
  Gene Symbol: GABRA2
  Gene Name: gamma-aminobutyric acid (GABA) A receptor, alpha 2
  Uniprot ID: P47869
  ENSP ID: ENSP00000421828

SEQ ID NO: 33890 - protein, 159 aa, Homo sapiens
  Payload ID: 6683
  Gene Symbol: GABRA2
  Gene Name: gamma-aminobutyric acid (GABA) A receptor, alpha 2
  ENSP ID: ENSP00000422642
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMR

SEQ ID NO: 33891 - protein, 73 aa, Homo sapiens
  Payload ID: 6683
  Gene Symbol: GABRA2
  Gene Name: gamma-aminobutyric acid (GABA) A receptor, alpha 2
  ENSP ID: ENSP00000422805
MKTKLNIYNMQFLLFVFLVWDPARLVLANIQEDEAKNNITIFTRILDRLLDGYDNRLRPGLGVSRVESPVCVT

SEQ ID NO: 33892 - protein, 367 aa, Homo sapiens
  Payload ID: 6683
  Gene Symbol: GABRA2
  Gene Name: gamma-aminobutyric acid (GABA) A receptor, alpha 2
  ENSP ID: ENSP00000423840
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKVSESFRVIIIKKIP

SEQ ID NO: 33893 - protein, 137 aa, Homo sapiens
  Payload ID: 6683
  Gene Symbol: GABRA2
  Gene Name: gamma-aminobutyric acid (GABA) A receptor, alpha 2
  ENSP ID: ENSP00000424093
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAH

SEQ ID NO: 33894 - protein, 151 aa, Homo sapiens
  Payload ID: 6683
  Gene Symbol: GABRA2
  Gene Name: gamma-aminobutyric acid (GABA) A receptor, alpha 2
  ENSP ID: ENSP00000424362
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDD

SEQ ID NO: 33895 - protein, 56 aa, Homo sapiens
  Payload ID: 6683
  Gene Symbol: GABRA2
  Gene Name: gamma-aminobutyric acid (GABA) A receptor, alpha 2
  ENSP ID: ENSP00000425240
SSTGEYTVMTAHFHLKRKIGYFVIQTYLPCIMTVILSQVSFWLNRESVPARTVFGE

SEQ ID NO: 33896 - protein, 66 aa, Homo sapiens; identical to SEQ ID NO: 33888
  Payload ID: 6683
  Gene Symbol: GABRA2
  Gene Name: gamma-aminobutyric acid (GABA) A receptor, alpha 2
  ENSP ID: ENSP00000425526

SEQ ID NO: 33897 - protein, 511 aa, Homo sapiens
  Payload ID: 6683
  Gene Symbol: GABRA2
  Gene Name: gamma-aminobutyric acid (GABA) A receptor, alpha 2
  ENSP ID: ENSP00000427603
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKSPSIKAEGITLTYNSVKAILQGAKLIWSKYIAFSWPSLFQEKTLEYLEKWMDCLTFKQSSKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 33898 - protein, 427 aa, Homo sapiens
  Payload ID: 6683
  Gene Symbol: GABRA2
  Gene Name: gamma-aminobutyric acid (GABA) A receptor, alpha 2
  ENSP ID: ENSP00000444409
MEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKSPSIKAEGITLTYNSVKAILQGAKLIWSKYIAFSWPSLFQEKTLEYLEKWMDCLTFKQSSKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 33899 - protein, 66 aa, Homo sapiens; identical to SEQ ID NO: 33888
  Payload ID: 6683
  Gene Symbol: GABRA2
  Gene Name: gamma-aminobutyric acid (GABA) A receptor, alpha 2
  ENSP ID: ENSP00000486333

SEQ ID NO: 33900 - protein, 492 aa, Homo sapiens
  Payload ID: 6684
  Gene Symbol: GABRA3
  Gene Name: gamma-aminobutyric acid (GABA) A receptor, alpha 3
  Uniprot ID: P34903
  ENSP ID: ENSP00000359337
MIITQTSHCYMTSLGILFLINILPGTTGQGESRRQEPGDFVKQDIGGLSPKHAPDIPDDSTDNITIFTRILDRLLDGYDNRLRPGLGDAVTEVKTDIYVTSFGPVSDTDMEYTIDVFFRQTWHDERLKFDGPMKILPLNNLLASKIWTPDTFFHNGKKSVAHNMTTPNKLLRLVDNGTLLYTMRLTIHAECPMHLEDFPMDVHACPLKFGSYAYTTAEVVYSWTLGKNKSVEVAQDGSRLNQYDLLGHVVGTEIIRSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRSWAWEGKKVPEALEMKKKTPAAPAKKTSTTFNIVGTTYPINLAKDTEFSTISKGAAPSASSTPTIIASPKATYVQDSPTETKTYNSVSKVDKISRIIFPVLFAIFNLVYWATYVNRESAIKGMIRKQ

SEQ ID NO: 33901 - protein, 492 aa, Homo sapiens; identical to SEQ ID NO: 33900
  Payload ID: 6684
  Gene Symbol: GABRA3
  Gene Name: gamma-aminobutyric acid (GABA) A receptor, alpha 3
  Uniprot ID: P34903
  ENSP ID: ENSP00000443527

SEQ ID NO: 33902 - protein, 554 aa, Homo sapiens [sequence omitted]

SEQ ID NO: 33903 - protein, 36 aa, Homo sapiens
  Payload ID: 6685
  Gene Symbol: GABRA4
  Gene Name: gamma-aminobutyric acid (GABA) A receptor, alpha 4
  ENSP ID: ENSP00000422152
MVSAKKFKRIPRTEPKGGEIVHRKFHPHPGQFARWL

SEQ ID NO: 33904 - protein, 36 aa, Homo sapiens
  Payload ID: 6685
  Gene Symbol: GABRA4
  Gene Name: gamma-aminobutyric acid (GABA) A receptor, alpha 4
  ENSP ID: ENSP00000424386
MVSAKKVPAIALSAGVSFALLRFLCLAVWSCYRSEN

SEQ ID NO: 33905 - protein, 36 aa, Homo sapiens; identical to SEQ ID NO: 33903
  Payload ID: 6685
  Gene Symbol: GABRA4
  Gene Name: gamma-aminobutyric acid (GABA) A receptor, alpha 4
  ENSP ID: ENSP00000425445

SEQ ID NO: 33906 - protein, 462 aa, Homo sapiens
  Payload ID: 6686
  Gene Symbol: GABRA5
  Gene Name: gamma-aminobutyric acid (GABA) A receptor, alpha 5
  Uniprot ID: P31644
  ENSP ID: ENSP00000335592
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPNSEVVYVWTNGSTKSVVVAEDGSRLNQYHLMGQTVGTENISTSTGEYTIMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKKALEAAKIKKKREVILNKSTNAFTTGKMSHPPNIPKEQTPAGTSNTTSVSVKPSEEKTSESKKTYNSISKIDKMSRIVFPVLFGTFNLVYWATYLNREPVIKGAASPK

SEQ ID NO: 33907 - protein, 462 aa, Homo sapiens; identical to SEQ ID NO: 33906
  Payload ID: 6686
  Gene Symbol: GABRA5
  Gene Name: gamma-aminobutyric acid (GABA) A receptor, alpha 5
  Uniprot ID: P31644
  ENSP ID: ENSP00000347557

SEQ ID NO: 33908 - protein, 462 aa, Homo sapiens; identical to SEQ ID NO: 33906
  Payload ID: 6686
  Gene Symbol: GABRA5
  Gene Name: gamma-aminobutyric acid (GABA) A receptor, alpha 5
  Uniprot ID: P31644
  ENSP ID: ENSP00000382953

SEQ ID NO: 33909 - protein, 85 aa, Homo sapiens
  Payload ID: 6686
  Gene Symbol: GABRA5
  Gene Name: gamma-aminobutyric acid (GABA) A receptor, alpha 5
  ENSP ID: ENSP00000450529
MPTSSVKDETNDNITIFTRILDGLLDGYDNRLRPGLGERITQVRTDIYVTSFGPVSDTEMEYTIDVFFRQSWKDERLRFKGPMQR

SEQ ID NO: 33910 - protein, 166 aa, Homo sapiens
  Payload ID: 6686
  Gene Symbol: GABRA5
  Gene Name: gamma-aminobutyric acid (GABA) A receptor, alpha 5
  ENSP ID: ENSP00000450653
MPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPN

SEQ ID NO: 33911 - protein, 165 aa, Homo sapiens
  Payload ID: 6686
  Gene Symbol: GABRA5
  Gene Name: gamma-aminobutyric acid (GABA) A receptor, alpha 5
  ENSP ID: ENSP00000450717
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTM

SEQ ID NO: 33912 - protein, 148 aa, Homo sapiens
  Payload ID: 6686
  Gene Symbol: GABRA5
  Gene Name: gamma-aminobutyric acid (GABA) A receptor, alpha 5
  ENSP ID: ENSP00000450806
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTT

SEQ ID NO: 33913 - protein, 16 aa, Homo sapiens
  Payload ID: 6686
  Gene Symbol: GABRA5
  Gene Name: gamma-aminobutyric acid (GABA) A receptor, alpha 5
  ENSP ID: ENSP00000450932
MDNGMFSGFIMIKNLL

SEQ ID NO: 33914 - protein, 86 aa, Homo sapiens
  Payload ID: 6686
  Gene Symbol: GABRA5
  Gene Name: gamma-aminobutyric acid (GABA) A receptor, alpha 5
  ENSP ID: ENSP00000451527
MDNGMFSGFIMIKNLLLFCISMNLSSHFGFSQMPTSSVKDETNDNITIFTRILDGLLDGYDNRLRPGLGERITQVRTDIYVTSFGP

SEQ ID NO: 33915 - protein, 453 aa, Homo sapiens
  Payload ID: 6687
  Gene Symbol: GABRA6
  Gene Name: gamma-aminobutyric acid (GABA) A receptor, alpha 6
  Uniprot ID: Q16445
  ENSP ID: ENSP00000274545
MASSLPWLCIILWLENALGKLEVEGNFYSENVSRILDNLLEGYDNRLRPGFGGAVTEVKTDIYVTSFGPVSDVEMEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 33916 - protein, 191 aa, Homo sapiens
  Payload ID: 6687
  Gene Symbol: GABRA6
  Gene Name: gamma-aminobutyric acid (GABA) A receptor, alpha 6
  ENSP ID: ENSP00000427989
LMVSKIWTPDTFFRNGKKSIAHNMTTPNKLFRIMQNGTILYTMRLTINADCPMRLVNFPMDGHACPLKFGSYNVHFEGKKDNSSNSLLYLICFKYLDAYPKSEIIYTWKKGPLYSVEVPEESSSLLQYDLIGQTVSSETIKSNTGEYVIMTVYFHLQRKMGYFMIQIYTPCIMTVILSQVSFWINKESVPA

SEQ ID NO: 33917 - protein, 197 aa, Homo sapiens
  Payload ID: 6687
  Gene Symbol: GABRA6
  Gene Name: gamma-aminobutyric acid (GABA) A receptor, alpha 6
  ENSP ID: ENSP00000429943
  MOD_RES (1)..(1): Any amino acid
XIEDGPVGVLGTLFQEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVIL

SEQ ID NO: 33918 - protein, 185 aa, Homo sapiens
  Payload ID: 6687
  Gene Symbol: GABRA6
  Gene Name: gamma-aminobutyric acid (GABA) A receptor, alpha 6
  ENSP ID: ENSP00000430212
SRCSGDSVPGTDGCSIHKRVFIEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQR

SEQ ID NO: 33919 - protein, 443 aa, Homo sapiens
  Payload ID: 6687
  Gene Symbol: GABRA6
  Gene Name: gamma-aminobutyric acid (GABA) A receptor, alpha 6
  ENSP ID: ENSP00000430527
MASSLPWLCIILWLENALGKLEVEGNFYSENVSRILDNLLEGYDNRLRPGFGGAVTEVKTDIYVTSFGPVSDVEMTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 33920 - protein, 474 aa, Homo sapiens
  Payload ID: 6688
  Gene Symbol: GABRB1
  Gene Name: gamma-aminobutyric acid (GABA) A receptor, beta 1
  Uniprot ID: P18505
  ENSP ID: ENSP00000295454
MWTVQNRESLGLLSFPVMITMVCCAHSTNEPSNMSYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWNGGEGAVTGVNKIELPQFSIVDYKMVSKKVEFTTGAYPRLSLSFRLKRNIGYFILQTYMPSTLITILSWVSFWINYDASAARVALGITTVLTMTTISTHLRETLPKIPYVKAIDIYLMGCFVFVFLALLEYAFVNYIFFGKGPQKKGASKQDQSANEKNKLEMNKVQVDAHGNILLSTLEIRNETSGSEVLTSVSDPKATMYSYDSASIQYRKPLSSREAYGRALDRHGVPSKGRIRRRASQLKVKIPDLTDVNSIDKWSRMFFPITFSLFNVVYWLYYVH

SEQ ID NO: 33921 - protein, 117 aa, Homo sapiens
  Payload ID: 6688
  Gene Symbol: GABRB1
  Gene Name: gamma-aminobutyric acid (GABA) A receptor, beta 1
  ENSP ID: ENSP00000426753
MSYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVL

SEQ ID NO: 33922 - protein, 87 aa, Homo sapiens
  Payload ID: 6688
  Gene Symbol: GABRB1
  Gene Name: gamma-aminobutyric acid (GABA) A receptor, beta 1
  Uniprot ID: P18505
  ENSP ID: ENSP00000426766
MWTVQNRESLGLLSFPVMITMVCCAHSTNEPSNMSYVKETVDRLLKGYDIRLRPDFGGLYTHHVFPAVLERQKAFLFWNPTEPHPRQ

SEQ ID NO: 33923 - protein, 474 aa, Homo sapiens
  Payload ID: 6689
  Gene Symbol: GABRB2
  Gene Name: gamma-aminobutyric acid (GABA) A receptor, beta 2
  Uniprot ID: P47870
  ENSP ID: ENSP00000274546
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 33924 - protein, 512 aa, Homo sapiens
  Payload ID: 6689
  Gene Symbol: GABRB2
  Gene Name: gamma-aminobutyric acid (GABA) A receptor, beta 2
  Uniprot ID: P47870
  ENSP ID: ENSP00000274547
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKIFYKDIKQNGTQYRSLWDPTGNLSPTRRTTNYDFSLYTMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 33925 - protein, 512 aa, Homo sapiens; identical to SEQ ID NO: 33924
  Payload ID: 6689
  Gene Symbol: GABRB2
  Gene Name: gamma-aminobutyric acid (GABA) A receptor, beta 2
  Uniprot ID: P47870
  ENSP ID: ENSP00000377531

SEQ ID NO: 33926 - protein, 474 aa, Homo sapiens; identical to SEQ ID NO: 33923
  Payload ID: 6689
  Gene Symbol: GABRB2
  Gene Name: gamma-aminobutyric acid (GABA) A receptor, beta 2
  Uniprot ID: P47870
  ENSP ID: ENSP00000429320

SEQ ID NO: 33927 - protein, 314 aa, Homo sapiens
  Payload ID: 6689
  Gene Symbol: GABRB2
  Gene Name: gamma-aminobutyric acid (GABA) A receptor, beta 2
  ENSP ID: ENSP00000429750
MMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 33928 - protein, 411 aa, Homo sapiens
  Payload ID: 6689
  Gene Symbol: GABRB2
  Gene Name: gamma-aminobutyric acid (GABA) A receptor, beta 2
  ENSP ID: ENSP00000430532
MNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 33929 - protein, 313 aa, Homo sapiens
  Payload ID: 6689
  Gene Symbol: GABRB2
  Gene Name: gamma-aminobutyric acid (GABA) A receptor, beta 2
  Uniprot ID: P47870
  ENSP ID: ENSP00000480066
MNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKVNSEGKPSLLLKLMEEC

SEQ ID NO: 33930 - protein, 473 aa, Homo sapiens
  Payload ID: 6690
  Gene Symbol: GABRB3
  Gene Name: gamma-aminobutyric acid (GABA) A receptor, beta 3
  Uniprot ID: P28472
  ENSP ID: ENSP00000299267
MCSGLLELLLPIWLSWTLGTRGSEPRSVNDPGNMSFVKETVDKLLKGYDIRLRPDFGGPPVCVGMNIDIASIDMVSEVNMDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 33931 - protein, 473 aa, Homo sapiens [sequence omitted]

SEQ ID NO: 33932 - protein, 402 aa, Homo sapiens
  Payload ID: 6690
  Gene Symbol: GABRB3
  Gene Name: gamma-aminobutyric acid (GABA) A receptor, beta 3
  Uniprot ID: P28472
  ENSP ID: ENSP00000383049
MWATYQTEEDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 33933 - protein, 388 aa, Homo sapiens
  Payload ID: 6690
  Gene Symbol: GABRB3
  Gene Name: gamma-aminobutyric acid (GABA) A receptor, beta 3
  Uniprot ID: P28472
  ENSP ID: ENSP00000439169
MYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 33934 - protein, 529 aa, Homo sapiens
  Payload ID: 6690
  Gene Symbol: GABRB3
  Gene Name: gamma-aminobutyric acid (GABA) A receptor, beta 3
  ENSP ID: ENSP00000442408
MQQLRRLWVLAAQPFCHLPERCRLFFEIGGISLAMPQCLLWICLAVWEARGDLPFIAENDAVLTVNWNAVKEHRTFYAIYETSVNDPGNMSFVKETVDKLLKGYDIRLRPDFGGPPVCVGMNIDIASIDMVSEVNMDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 33935 - protein, 105 aa, Homo sapiens
  Payload ID: 6690
  Gene Symbol: GABRB3
  Gene Name: gamma-aminobutyric acid (GABA) A receptor, beta 3
  ENSP ID: ENSP00000451077
MWGLAGGRLFGIFSAPVLVAVVCCAQSVNDPGNMSFVKETVDKLLKGYDIRLRPDFGGPPVCVGMNIDIASIDMVSEVNMNHHDSSMHDGPQEIPPGRAELHSGN

SEQ ID NO: 33936 - protein, 87 aa, Homo sapiens
  Payload ID: 6690
  Gene Symbol: GABRB3
  Gene Name: gamma-aminobutyric acid (GABA) A receptor, beta 3
  ENSP ID: ENSP00000452041
MWGLAGGRLFGIFSAPVLVAVVCCAQSVNDPGNMSFVKETVDKLLKGYDIRLRPDFGGPPVCVGMNIDIASIDMVSEVNMAMQELHS

SEQ ID NO: 33937 - protein, 44 aa, Homo sapiens
  Payload ID: 6690
  Gene Symbol: GABRB3
  Gene Name: gamma-aminobutyric acid (GABA) A receptor, beta 3
  ENSP ID: ENSP00000452159
  MOD_RES (1)..(1): Any amino acid
XLNDKKSFVHGVTVKNRMIRLHPDGTVLYGLRYYGPGLEEVWHS

SEQ ID NO: 33938 - protein, 388 aa, Homo sapiens; identical to SEQ ID NO: 33933
  Payload ID: 6690
  Gene Symbol: GABRB3
  Gene Name: gamma-aminobutyric acid (GABA) A receptor, beta 3
  Uniprot ID: P28472
  ENSP ID: ENSP00000481004

SEQ ID NO: 33939 - protein, 388 aa, Homo sapiens; identical to SEQ ID NO: 33933
  Payload ID: 6690
  Gene Symbol: GABRB3
  Gene Name: gamma-aminobutyric acid (GABA) A receptor, beta 3
  Uniprot ID: P28472
  ENSP ID: ENSP00000486819

SEQ ID NO: 33940 - protein, 452 aa, Homo sapiens [sequence omitted]

SEQ ID NO: 33941 - protein, 506 aa, Homo sapiens
  Payload ID: 6692
  Gene Symbol: GABRE
  Gene Name: gamma-aminobutyric acid (GABA) A receptor, epsilon
  Uniprot ID: P78334
  ENSP ID: ENSP00000359353
MLSKVLPVLLGILLILQSRVEGPQTESKNEASSRDVVYGPQPQPLENQLLSEETKSTETETGSRVGKLPEASRILNTILSNYDHKLRPGIGEKPTVVTVEISVNSLGPLSILDMEYTIDIIFSQTWYDERLCYNDTFESLVLNGNVVSQLWIPDTFFRNSKRTHEHEITMPNQMVRIYKDGKVLYTIRMTIDAGCSLHMLRFPMDSHSCPLSFSSFSYPENEMIYKWENFKLEINEKNSWKLFQFDFTGVSNKTEIITTPVGDFMVMTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 33942 - protein, 43 aa, Homo sapiens
  Payload ID: 6692
  Gene Symbol: GABRE
  Gene Name: gamma-aminobutyric acid (GABA) A receptor, epsilon
  ENSP ID: ENSP00000389384
MLSKVLPVLLGILLILQSRTCIQRSAQIISVQLMSCQNMTTAV

SEQ ID NO: 33943 - protein, 43 aa, Homo sapiens; identical to SEQ ID NO: 33942
  Payload ID: 6692
  Gene Symbol: GABRE
  Gene Name: gamma-aminobutyric acid (GABA) A receptor, epsilon
  ENSP ID: ENSP00000397335

SEQ ID NO: 33944 - protein, 465 aa, Homo sapiens
  Payload ID: 6693
  Gene Symbol: GABRG1
  Gene Name: gamma-aminobutyric acid (GABA) A receptor, gamma 1
  Uniprot ID: Q8N1C3
  ENSP ID: ENSP00000295452
MGPLKAFLFSPFLLRSQSRGVRLVFLLLTLHLGNCVDKADDEDDEDLTVNKTWVLAPKIHEGDITQILNSLLQGYDNKLRPDIGVRPTVIETDVYVNSIGPVDPINMEYTIDIIFAQTWFDSRLKFNSTMKVLMLNSNMVGKIWIPDTFFRNSRKSDAHWITTPNRLLRIWNDGRVLYTLRLTINAECYLQLHNFPMDEHSCPLEFSSYGYPKNEIEYKWKKPSVEVADPKYWRLYQFAFVGLRNSTEITHTISGDYVIMTIFFDLSRRMGYFTIQTYIPCILTVVLSWVSFWINKDAVPARTSLGITTVLTMTTLSTIARKSLPKVSYVTAMDLFVSVCFIFVFAALMEYGTLHYFTSNQKGKTATKDRKLKNKASMTPGLHPGSTLIPMNNISVPQEDDYGYQCLEGKDCASFFCCFEDCRTGSWREGRIHIRIAKIDSYSRIFFPTAFALFNLVYWVGYLYL

SEQ ID NO: 33945 - protein, 475 aa, Homo sapiens
  Payload ID: 6694
  Gene Symbol: GABRG2
  Gene Name: gamma-aminobutyric acid (GABA) A receptor, gamma 2
  Uniprot ID: P18507
  ENSP ID: ENSP00000349000
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 33946 - protein, 467 aa, Homo sapiens
  Payload ID: 6694
  Gene Symbol: GABRG2
  Gene Name: gamma-aminobutyric acid (GABA) A receptor, gamma 2
  Uniprot ID: P18507
  ENSP ID: ENSP00000354651
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 33947 - protein, 515 aa, Homo sapiens
  Payload ID: 6694
  Gene Symbol: GABRG2
  Gene Name: gamma-aminobutyric acid (GABA) A receptor, gamma 2
  Uniprot ID: P18507
  ENSP ID: ENSP00000410732
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSWSRSIAQAGMCSGVISAHYSLRFWGSTDPPTLASRVAGISDGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 33948 - protein, 51 aa, Homo sapiens
  Payload ID: 6694
  Gene Symbol: GABRG2
  Gene Name: gamma-aminobutyric acid (GABA) A receptor, gamma 2
  ENSP ID: ENSP00000430124
MSSPNIWSTGSSVYSTPVFSQKMTVWILLLLSLYPGRKLSSYPHKLRFENE

SEQ ID NO: 33949 - protein, 222 aa, Homo sapiens
  Payload ID: 6694
  Gene Symbol: GABRG2
  Gene Name: gamma-aminobutyric acid (GABA) A receptor, gamma 2
  ENSP ID: ENSP00000430182
MYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTT

SEQ ID NO: 33950 - protein, 111 aa, Homo sapiens
  Payload ID: 6694
  Gene Symbol: GABRG2
  Gene Name: gamma-aminobutyric acid (GABA) A receptor, gamma 2
  ENSP ID: ENSP00000430732
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMHH

SEQ ID NO: 33951 - protein, 288 aa, Homo sapiens
  Payload ID: 6695
  Gene Symbol: GABRG3
  Gene Name: gamma-aminobutyric acid (GABA) A receptor, gamma 3
  ENSP ID: ENSP00000331912
MDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPTAMITLNNSVYWQEFEDTCVYECLDGKDCQSFFCCYEECKSGSWRKGRIHIDILELDSYSRVFFPTSFLLFNLVYWVGYLYL

SEQ ID NO: 33952 - protein, 169 aa, Homo sapiens
  Payload ID: 6695
  Gene Symbol: GABRG3
  Gene Name: gamma-aminobutyric acid (GABA) A receptor, gamma 3
  ENSP ID: ENSP00000390708
  MOD_RES (1)..(1): Any amino acid
XDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSKPSCCPACGLQGLPFRSLVSHPRISRAFCLPV

SEQ ID NO: 33953 - protein, 38 aa, Homo sapiens
  Payload ID: 6695
  Gene Symbol: GABRG3
  Gene Name: gamma-aminobutyric acid (GABA) A receptor, gamma 3
  ENSP ID: ENSP00000450976
  MOD_RES (1)..(1): Any amino acid
XAECQLQLHNFPMDEHSCPLIFSSSTILAFRLSLHAYR

SEQ ID NO: 33954 - protein, 258 aa, Homo sapiens
  Payload ID: 6695
  Gene Symbol: GABRG3
  Gene Name: gamma-aminobutyric acid (GABA) A receptor, gamma 3
  ENSP ID: ENSP00000451862
EAGVRGTEEDGCWVCNLESVSQSQTWQENKLSEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAM

SEQ ID NO: 33955 - protein, 253 aa, Homo sapiens
  Payload ID: 6695
  Gene Symbol: GABRG3
  Gene Name: gamma-aminobutyric acid (GABA) A receptor, gamma 3
  Uniprot ID: Q99928
  ENSP ID: ENSP00000452244
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGRNLLKEAQLSKAREA

SEQ ID NO: 33956 - protein, 467 aa, Homo sapiens
  Payload ID: 6695
  Gene Symbol: GABRG3
  Gene Name: gamma-aminobutyric acid (GABA) A receptor, gamma 3
  Uniprot ID: Q99928
  ENSP ID: ENSP00000479113
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPTAMITLNNSVYWQEFEDTCVYECLDGKDCQSFFCCYEECKSGSWRKGRIHIDILELDSYSRVFFPTSFLLFNLVYWVGYLYL

SEQ ID NO: 33957 - protein, 440 aa, Homo sapiens
  Payload ID: 6696
  Gene Symbol: GABRP
  Gene Name: gamma-aminobutyric acid (GABA) A receptor, pi
  Uniprot ID: O00591
  ENSP ID: ENSP00000265294
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRGTTKEVEEVSITNIINSSISSFKRKISFASIEISSDNVDYSDLTMKTSDKFKFVFREKMGRIVDYFTIQNPSNVDHYSKLLFPLIFMLANVFYWAYYMYF

SEQ ID NO: 33958 - protein, 92 aa, Homo sapiens
  Payload ID: 6696
  Gene Symbol: GABRP
  Gene Name: gamma-aminobutyric acid (GABA) A receptor, pi
  ENSP ID: ENSP00000428103
MNYSLHLAFVCLSLFTERMCIQGSQFNVEVGRSDKLSLPGFENLTAGYNKFLRPNFGGEPVQIALTLDIASISSISESNMDYTATIYLRQRW

SEQ ID NO: 33959 - protein, 171 aa, Homo sapiens
  Payload ID: 6696
  Gene Symbol: GABRP
  Gene Name: gamma-aminobutyric acid (GABA) A receptor, pi
  ENSP ID: ENSP00000428804
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDT

SEQ ID NO: 33960 - protein, 59 aa, Homo sapiens
  Payload ID: 6696
  Gene Symbol: GABRP
  Gene Name: gamma-aminobutyric acid (GABA) A receptor, pi
  ENSP ID: ENSP00000429668
MNYSLHLAFVCLSLFTERMCIQGSQFNVEVGRSDKLSLPGFENLTAGYNKFLRPNFGGE

SEQ ID NO: 33961 - protein, 52 aa, Homo sapiens
  Payload ID: 6696
  Gene Symbol: GABRP
  Gene Name: gamma-aminobutyric acid (GABA) A receptor, pi
  ENSP ID: ENSP00000429815
MNYSLHLAFVCLSLFTERMCIQGSQFNVEVGRSDKLSLPGFENLTAGYNKFL

SEQ ID NO: 33962 - protein, 440 aa, Homo sapiens; identical to SEQ ID NO: 33957
  Payload ID: 6696
  Gene Symbol: GABRP
  Gene Name: gamma-aminobutyric acid (GABA) A receptor, pi
  Uniprot ID: O00591
  ENSP ID: ENSP00000430100

SEQ ID NO: 33963 - protein, 189 aa, Homo sapiens
  Payload ID: 6696
  Gene Symbol: GABRP
  Gene Name: gamma-aminobutyric acid (GABA) A receptor, pi
  ENSP ID: ENSP00000430188
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVE

SEQ ID NO: 33964 - protein, 289 aa, Homo sapiens
  Payload ID: 6696
  Gene Symbol: GABRP
  Gene Name: gamma-aminobutyric acid (GABA) A receptor, pi
  ENSP ID: ENSP00000430727
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGDNKGSRRSQYY

SEQ ID NO: 33965 - protein, 349 aa, Homo sapiens
  Payload ID: 6696
  Gene Symbol: GABRP
  Gene Name: gamma-aminobutyric acid (GABA) A receptor, pi
  ENSP ID: ENSP00000430772
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRQKICYLYAA

SEQ ID NO: 33966 - protein, 392 aa, Homo sapiens
  Payload ID: 6697
  Gene Symbol: GABRR1
  Gene Name: gamma-aminobutyric acid (GABA) A receptor, rho 1
  Uniprot ID: P24046
  ENSP ID: ENSP00000358463
MRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 33967 - protein, 462 aa, Homo sapiens
  Payload ID: 6697
  Gene Symbol: GABRR1
  Gene Name: gamma-aminobutyric acid (GABA) A receptor, rho 1
  Uniprot ID: P24046
  ENSP ID: ENSP00000394687
MLAVPNMRFGIFLLWWGWVLATESRMHWPGREVHEMSKKGSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 33968 - protein, 45 aa, Homo sapiens
  Payload ID: 6697
  Gene Symbol: GABRR1
  Gene Name: gamma-aminobutyric acid (GABA) A receptor, rho 1
  ENSP ID: ENSP00000410130
MLAVPNMRFGIFLLWWGWVLATESRMHWPGREVHEMSKKGRIEAS

SEQ ID NO: 33969 - protein, 479 aa, Homo sapiens
  Payload ID: 6697
  Gene Symbol: GABRR1
  Gene Name: gamma-aminobutyric acid (GABA) A receptor, rho 1
  Uniprot ID: P24046
  ENSP ID: ENSP00000412673
MLAVPNMRFGIFLLWWGWVLATESRMHWPGREVHEMSKKGRPQRQRREVHEDAHKQVSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 33970 - protein, 392 aa, Homo sapiens; identical to SEQ ID NO: 33966
  Payload ID: 6697
  Gene Symbol: GABRR1
  Gene Name: gamma-aminobutyric acid (GABA) A receptor, rho 1
  Uniprot ID: P24046
  ENSP ID: ENSP00000478846

SEQ ID NO: 33971 - protein, 392 aa, Homo sapiens; identical to SEQ ID NO: 33966
  Payload ID: 6697
  Gene Symbol: GABRR1
  Gene Name: gamma-aminobutyric acid (GABA) A receptor, rho 1
  Uniprot ID: P24046
  ENSP ID: ENSP00000481986

SEQ ID NO: 33972 - protein, 465 aa, Homo sapiens
  Payload ID: 6698
  Gene Symbol: GABRR2
  Gene Name: gamma-aminobutyric acid (GABA) A receptor, rho 2
  Uniprot ID: P28476
  ENSP ID: ENSP00000386029
MPYFTRLILFLFCLMVLVESRKPKRKRWTGQVEMPKPSHLYKKNLDVTKIRKGKPQQLLRVDEHDFSMRPAFGGPAIPVGVDVQVESLDSISEVDMDFTMTLYLRHYWKDERLAFSSASNKSMTFDGRLVKKIWVPDVFFVHSKRSFTHDTTTDNIMLRVFPDGHVLYSMRITVTAMCNMDFSHFPLDSQTCSLELESYAYTDEDLMLYWKNGDESLKTDEKISLSQFLIQKFHTTSRLAFYSSTGWYNRLYINFTLRRHIFFFLLQTYFPATLMVMLSWVSFWIDRRAVPARVSLGITTVLTMTTIITGVNASMPRVSYVKAVDIYLWVSFVFVFLSVLEYAAVNYLTTVQERKERKLREKFPCMCGMLHSKTMMLDGSYSESEANSLAGYPRSHILTEEERQDKIVVHLGLSGEANAARKKGLLKGQTGFRIFQNTHAIDKYSRLIFPASYIFFNLIYWSVFS

SEQ ID NO: 33973 - protein, 467 aa, Homo sapiens
  Payload ID: 6699
  Gene Symbol: GABRR3
  Gene Name: gamma-aminobutyric acid (GABA) A receptor, rho 3 (gene/pseudogene)
  Uniprot ID: A8MPY1
  ENSP ID: ENSP00000420790
MVLAFQLVSFTYIWIILKPNVCAASNIKMTHQRCSSSMKQTCKQETRMKKDDSTKARPQKYEQLLHIEDNDFAMRPGFGGSPVPVGIDVHVESIDSISETNMDFTMTFYLRHYWKDERLSFPSTANKSMTFDHRLTRKIWVPDIFFVHSKRSFIHDTTMENIMLRVHPDGNVLLSLRITVSAMCFMDFSRFPLDTQNCSLELESYAYNEDDLMLYWKHGNKSLNTEEHMSLSQFFIEDFSASSGLAFYSSTGWYNRLFINFVLRRHVFFFVLQTYFPAILMVMLSWVSFWIDRRAVPARVSLGITTVLTMSTIITAVSASMPQVSYLKAVDVYLWVSSLFVFLSVIEYAAVNYLTTVEERKQFKKTGKISRMYNIDAVQAMAFDGCYHDSEIDMDQTSLSLNSEDFMRRKSICSPSTDSSRIKRRKSLGGHVGRIILENNHVIDTYSRILFPIVYILFNLFYWGVYV

SEQ ID NO: 33974 - protein, 467 aa, Homo sapiens; identical to SEQ ID NO: 33973
  Payload ID: 6699
  Gene Symbol: GABRR3
  Gene Name: gamma-aminobutyric acid (GABA) A receptor, rho 3 (gene/pseudogene)
  Uniprot ID: A8MPY1
  ENSP ID: ENSP00000481321

SEQ ID NO: 33975 - protein, 632 aa, Homo sapiens [sequence omitted]

SEQ ID NO: 33976 - protein, 844 aa, Homo sapiens
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000348248
MGPGAPFARVGWPLPLLVVMAAGVAPVWASHSPHLPRPHSRVPPHPSSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 33977 - protein, 578 aa, Homo sapiens
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000366176
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIVISRTHSPT

SEQ ID NO: 33978 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000366211

SEQ ID NO: 33979 - protein, 899 aa, Homo sapiens
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000366215
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 33980 - protein, 961 aa, Homo sapiens
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000366233
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 33981 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000373029

SEQ ID NO: 33982 - protein, 899 aa, Homo sapiens; identical to SEQ ID NO: 33979
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000373033

SEQ ID NO: 33983 - protein, 961 aa, Homo sapiens; identical to SEQ ID NO: 33980
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000373034

SEQ ID NO: 33984 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000373035

SEQ ID NO: 33985 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000373132

SEQ ID NO: 33986 - protein, 899 aa, Homo sapiens; identical to SEQ ID NO: 33979
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000373133

SEQ ID NO: 33987 - protein, 961 aa, Homo sapiens; identical to SEQ ID NO: 33980
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000373134

SEQ ID NO: 33988 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000373135

SEQ ID NO: 33989 - protein, 961 aa, Homo sapiens; identical to SEQ ID NO: 33980
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000388035

SEQ ID NO: 33990 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000391572

SEQ ID NO: 33991 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000394528

SEQ ID NO: 33992 - protein, 899 aa, Homo sapiens; identical to SEQ ID NO: 33979
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000399318

SEQ ID NO: 33993 - protein, 899 aa, Homo sapiens; identical to SEQ ID NO: 33979
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000399861

SEQ ID NO: 33994 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000405709

SEQ ID NO: 33995 - protein, 961 aa, Homo sapiens; identical to SEQ ID NO: 33980
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000406066

SEQ ID NO: 33996 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000406285

SEQ ID NO: 33997 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000406499

SEQ ID NO: 33998 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000408938

SEQ ID NO: 33999 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000411263

SEQ ID NO: 34000 - protein, 961 aa, Homo sapiens; identical to SEQ ID NO: 33980
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000411286

SEQ ID NO: 34001 - protein, 899 aa, Homo sapiens
  Payload ID: 6701
  Gene Symbol: GABBR1
  Gene Name: gamma-aminobutyric acid (GABA) B receptor, 1
  ENSP ID: ENSP00000412044
MLLLLLLAPLFLRPPGAGGVQTPNATSEGCQIIHPPWEGGIRYRGLTRDQVKAINFLPVDYEIEYVCRGEREVVGPKVRKCLANGSWTDMDTPSRCVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 34002 - protein, 899 aa, Homo sapiens; identical to SEQ ID NO: 33979
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000412167

SEQ ID NO: 34003 - protein, 961 aa, Homo sapiens
  Payload ID: 6701
  Gene Symbol: GABBR1
  Gene Name: gamma-aminobutyric acid (GABA) B receptor, 1
  ENSP ID: ENSP00000416731
MLLLLLLAPLFLRPPGAGGVQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 34004 - protein, 844 aa, Homo sapiens; identical to SEQ ID NO: 33976
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000416903

SEQ ID NO: 34005 - protein, 133 aa, Homo sapiens
  Payload ID: 6701
  Gene Symbol: GABBR1
  Gene Name: gamma-aminobutyric acid (GABA) B receptor, 1
  ENSP ID: ENSP00000417332
MPGAWMLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVD

SEQ ID NO: 34006 - protein, 137 aa, Homo sapiens
  Payload ID: 6701
  Gene Symbol: GABBR1
  Gene Name: gamma-aminobutyric acid (GABA) B receptor, 1
  ENSP ID: ENSP00000417478
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHL

SEQ ID NO: 34007 - protein, 97 aa, Homo sapiens
  Payload ID: 6701
  Gene Symbol: GABBR1
  Gene Name: gamma-aminobutyric acid (GABA) B receptor, 1
  ENSP ID: ENSP00000417663
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCV

SEQ ID NO: 34008 - protein, 578 aa, Homo sapiens; identical to SEQ ID NO: 33977
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000419061

SEQ ID NO: 34009 - protein, 131 aa, Homo sapiens
  Payload ID: 6701
  Gene Symbol: GABBR1
  Gene Name: gamma-aminobutyric acid (GABA) B receptor, 1
  ENSP ID: ENSP00000419356
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCGTLPSETQASALPGLQHGQVWEGAGDQAREAGRQW

SEQ ID NO: 34010 - protein, 156 aa, Homo sapiens
  Payload ID: 6701
  Gene Symbol: GABBR1
  Gene Name: gamma-aminobutyric acid (GABA) B receptor, 1
  ENSP ID: ENSP00000419755
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPH

SEQ ID NO: 34011 - protein, 193 aa, Homo sapiens
  Payload ID: 6701
  Gene Symbol: GABBR1
  Gene Name: gamma-aminobutyric acid (GABA) B receptor, 1
  ENSP ID: ENSP00000420602
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQGTLPSETQASALPGLQHGQVWEGAGDQAREAGRQW

SEQ ID NO: 34012 - protein, 578 aa, Homo sapiens; identical to SEQ ID NO: 33977
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000446983

SEQ ID NO: 34013 - protein, 578 aa, Homo sapiens; identical to SEQ ID NO: 33977
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000448531

SEQ ID NO: 34014 - protein, 578 aa, Homo sapiens; identical to SEQ ID NO: 33977
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000448654

SEQ ID NO: 34015 - protein, 578 aa, Homo sapiens
  Payload ID: 6701
  Gene Symbol: GABBR1
  Gene Name: gamma-aminobutyric acid (GABA) B receptor, 1
  ENSP ID: ENSP00000448763
MLLLLLLAPLFLRPPGAGGVQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIVISRTHSPT

SEQ ID NO: 34016 - protein, 961 aa, Homo sapiens; identical to SEQ ID NO: 33980
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000448999

SEQ ID NO: 34017 - protein, 578 aa, Homo sapiens; identical to SEQ ID NO: 33977
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000449342

SEQ ID NO: 34018 - protein, 578 aa, Homo sapiens; identical to SEQ ID NO: 33977
  Payload ID: 6701
  Gene Symbol: GABBR1
  Gene Name: gamma-aminobutyric acid (GABA) B receptor, 1
  Uniprot ID: Q9UBS5
  ENSP ID: ENSP00000449449

SEQ ID NO: 34019 - protein, 941 aa, Homo sapiens
  Payload ID: 6702
  Gene Symbol: GABBR2
  Gene Name: gamma-aminobutyric acid (GABA) B receptor, 2
  Uniprot ID: O75899
  ENSP ID: ENSP00000259455
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 34020 - protein, 183 aa, Homo sapiens
  Payload ID: 6702
  Gene Symbol: GABBR2
  Gene Name: gamma-aminobutyric acid (GABA) B receptor, 2
  ENSP ID: ENSP00000489352
VRTWILTVGYTTAFGAMFAKTWRVHAIFKNVKMKKKIIKDQKLLVIVGGMLLIDLCILICWQAVDPLRRTVEKYSMELFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTS

SEQ ID NO: 34021 - protein, 758 aa, Homo sapiens
  Payload ID: 6703
  Gene Symbol: GGCX
  Gene Name: gamma-glutamyl carboxylase
  Uniprot ID: P38435
  ENSP ID: ENSP00000233838
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 34022 - protein, 123 aa, Homo sapiens
  Payload ID: 6703
  Gene Symbol: GGCX
  Gene Name: gamma-glutamyl carboxylase
  ENSP ID: ENSP00000389426
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMETGPVVIS

SEQ ID NO: 34023 - protein, 73 aa, Homo sapiens
  Payload ID: 6703
  Gene Symbol: GGCX
  Gene Name: gamma-glutamyl carboxylase
  ENSP ID: ENSP00000390748
MAVSAGSARTSPSSGFLMVLDIPQERGLSSLDRKYLDGLDVCRFPLLDALRPLPLDWMYLVYTIMFLGKLGLW

SEQ ID NO: 34024 - protein, 66 aa, Homo sapiens
  Payload ID: 6703
  Gene Symbol: GGCX
  Gene Name: gamma-glutamyl carboxylase
  ENSP ID: ENSP00000400384
MAVSAGSARTSPSSGFLMVLDIPQERGLSSLDRKYLDGLDVCRFPLLDALRPLPLDWMETGPVVIS

SEQ ID NO: 34025 - protein, 701 aa, Homo sapiens
  Payload ID: 6703
  Gene Symbol: GGCX
  Gene Name: gamma-glutamyl carboxylase
  Uniprot ID: P38435
  ENSP ID: ENSP00000408045
MAVSAGSARTSPSSGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 34026 - protein, 318 aa, Homo sapiens
  Payload ID: 6704
  Gene Symbol: GGH
  Gene Name: gamma-glutamyl hydrolase (conjugase, folylpolygammaglutamyl hydrolase)
  Uniprot ID: Q92820
  ENSP ID: ENSP00000260118
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKNFTMNEKLKKFFNVLTTNTDGKIEFISTMEGYKYPVYGVQWHPEKAPYEWKNLDGISHAPNAVKTAFYLAEFFVNEARKNNHHFKSESEEEKALIYQFSPIYTGNISSFQQCYIFD

SEQ ID NO: 34027 - protein, 153 aa, Homo sapiens
  Payload ID: 6705
  Gene Symbol: GGACT
  Gene Name: gamma-glutamylamine cyclotransferase
  Uniprot ID: Q9BVM4
  ENSP ID: ENSP00000365426
MALVFVYGTLKRGQPNHRVLRDGAHGSAAFRARGRTLEPYPLVIAGEHNIPWLLHLPGSGRLVEGEVYAVDERMLRFLDDFESCPALYQRTVLRVQLLEDRAPGAEEPPAPTAVQCFVYSRATFPPEWAQLPHHDSYDSEGPHGLRYNPRENR

SEQ ID NO: 34028 - protein, 153 aa, Homo sapiens; identical to SEQ ID NO: 34027
  Payload ID: 6705
  Gene Symbol: GGACT
  Gene Name: gamma-glutamylamine cyclotransferase
  Uniprot ID: Q9BVM4
  ENSP ID: ENSP00000410449

SEQ ID NO: 34029 - protein, 26 aa, Homo sapiens
  Payload ID: 6705
  Gene Symbol: GGACT
  Gene Name: gamma-glutamylamine cyclotransferase
  ENSP ID: ENSP00000471322
MALVFVYGTLKRGQPNHRVLRDGAHG

SEQ ID NO: 34030 - protein, 32 aa, Homo sapiens
  Payload ID: 6705
  Gene Symbol: GGACT
  Gene Name: gamma-glutamylamine cyclotransferase
  ENSP ID: ENSP00000471342
MALVFVYGTLKRGQPNHRVLRDGAHGSAAFRA

SEQ ID NO: 34031 - protein, 26 aa, Homo sapiens
  Payload ID: 6705
  Gene Symbol: GGACT
  Gene Name: gamma-glutamylamine cyclotransferase
  ENSP ID: ENSP00000471716
MALVFVYGTLKRGQPNHRVLRDGAHG

SEQ ID NO: 34032 - protein, 32 aa, Homo sapiens; identical to SEQ ID NO: 34030
  Payload ID: 6705
  Gene Symbol: GGACT
  Gene Name: gamma-glutamylamine cyclotransferase
  ENSP ID: ENSP00000472246

SEQ ID NO: 34033 - protein, 114 aa, Homo sapiens
  Payload ID: 6706
  Gene Symbol: GGCT
  Gene Name: gamma-glutamylcyclotransferase
  Uniprot ID: O75223
  ENSP ID: ENSP00000005374
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDELFAWVQKKMVCRWSIKRS

SEQ ID NO: 34034 - protein, 188 aa, Homo sapiens
  Payload ID: 6706
  Gene Symbol: GGCT
  Gene Name: gamma-glutamylcyclotransferase
  Uniprot ID: O75223
  ENSP ID: ENSP00000275428
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEQEGVKSGMYVVIEVKVATQEGKEITCRSYLMTNYESAPPSPQYKKIICMGAKENGLPLEYQEKLKAIEPNDYTGKVSEEIEDIIKKGETQTL

SEQ ID NO: 34035 - protein, 94 aa, Homo sapiens
  Payload ID: 6706
  Gene Symbol: GGCT
  Gene Name: gamma-glutamylcyclotransferase
  Uniprot ID: O75223
  ENSP ID: ENSP00000386610
MANSGCKDVTGPDEESFLYFAYGSNLLTERIHLRNPSAAFFCVARLQIICMGAKENGLPLEYQEKLKAIEPNDYTGKVSEEIEDIIKKGETQTL

SEQ ID NO: 34036 - protein, 166 aa, Homo sapiens
  Payload ID: 6706
  Gene Symbol: GGCT
  Gene Name: gamma-glutamylcyclotransferase
  ENSP ID: ENSP00000386686
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEQEGVKSGMYVVIEVKVATQEGKEITCRSYLMTNYESAPPSPQYKKVEKETSHCLSESGKSPLQAQDKNVG

SEQ ID NO: 34037 - protein, 166 aa, Homo sapiens
  Payload ID: 6706
  Gene Symbol: GGCT
  Gene Name: gamma-glutamylcyclotransferase
  Uniprot ID: O75223
  ENSP ID: ENSP00000387235
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEWRKKRHTAFQNQGNHPCKHKTRMWDRDPKIPVQNLSLALCWQAQSGHGTCNRLFAWVQKKMVCRWSIKRS

SEQ ID NO: 34038 - protein, 51 aa, Homo sapiens
  Payload ID: 6706
  Gene Symbol: GGCT
  Gene Name: gamma-glutamylcyclotransferase
  ENSP ID: ENSP00000387809
MANSGCKDVTGPDEESFLYFAYGSNLLTERIHLRNPSAAFFCVARLQARRG

SEQ ID NO: 34039 - protein, 119 aa, Homo sapiens
  Payload ID: 6706
  Gene Symbol: GGCT
  Gene Name: gamma-glutamylcyclotransferase
  ENSP ID: ENSP00000390094
  MOD_RES (1)..(1): Any amino acid
XFKLDFGNSQGKTSQTWHGGIATIFQSPGDEVWGVVWKMNKSNLNSLDEQEGVKSGMYVVIEVKVATQEGKEITCRSYLMTNYESAPPSPQYKKVEKETSHCLSESGKSPLQAQDKNVG

SEQ ID NO: 34040 - protein, 51 aa, Homo sapiens; identical to SEQ ID NO: 34038
  Payload ID: 6706
  Gene Symbol: GGCT
  Gene Name: gamma-glutamylcyclotransferase
  ENSP ID: ENSP00000408015

SEQ ID NO: 34041 - protein, 569 aa, Homo sapiens
  Payload ID: 6707
  Gene Symbol: GGT1
  Gene Name: gamma-glutamyltransferase 1
  Uniprot ID: P19440
  ENSP ID: ENSP00000248923
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDVVLYMPSAPLSGPVLALILNILKGYNFSRESVESPEQKGLTYHRIVEAFRFAYAKRTLLGDPKFVDVTEVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 34042 - protein, 569 aa, Homo sapiens; identical to SEQ ID NO: 34041
  Payload ID: 6707
  Gene Symbol: GGT1
  Gene Name: gamma-glutamyltransferase 1
  Uniprot ID: P19440
  ENSP ID: ENSP00000383231

SEQ ID NO: 34043 - protein, 569 aa, Homo sapiens; identical to SEQ ID NO: 34041
  Payload ID: 6707
  Gene Symbol: GGT1
  Gene Name: gamma-glutamyltransferase 1
  Uniprot ID: P19440
  ENSP ID: ENSP00000383232

SEQ ID NO: 34044 - protein, 225 aa, Homo sapiens
  Payload ID: 6707
  Gene Symbol: GGT1
  Gene Name: gamma-glutamyltransferase 1
  Uniprot ID: P19440
  ENSP ID: ENSP00000384381
MTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 34045 - protein, 225 aa, Homo sapiens; identical to SEQ ID NO: 34044
  Payload ID: 6707
  Gene Symbol: GGT1
  Gene Name: gamma-glutamyltransferase 1
  Uniprot ID: P19440
  ENSP ID: ENSP00000384820

SEQ ID NO: 34046 - protein, 218 aa, Homo sapiens
  Payload ID: 6707
  Gene Symbol: GGT1
  Gene Name: gamma-glutamyltransferase 1
  ENSP ID: ENSP00000385001
MTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQPPSHADHTPMPQAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 34047 - protein, 252 aa, Homo sapiens
  Payload ID: 6707
  Gene Symbol: GGT1
  Gene Name: gamma-glutamyltransferase 1
  ENSP ID: ENSP00000385016
MTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALVCVTPFLPGRAHPAQPPSHADHTPMPQAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 34048 - protein, 225 aa, Homo sapiens; identical to SEQ ID NO: 34044
  Payload ID: 6707
  Gene Symbol: GGT1
  Gene Name: gamma-glutamyltransferase 1
  Uniprot ID: P19440
  ENSP ID: ENSP00000385445

SEQ ID NO: 34049 - protein, 366 aa, Homo sapiens
  Payload ID: 6707
  Gene Symbol: GGT1
  Gene Name: gamma-glutamyltransferase 1
  Uniprot ID: P19440
  ENSP ID: ENSP00000387499
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDVVLYMPSAPLSGPVLALILNILKGYNFSRESVESPEQKGLTYHRIVEAFRFAYAKRTLLGDPKFVDVTEASSGVSAGGPQHDLRVLRCPAPGPDL

SEQ ID NO: 34050 - protein, 116 aa, Homo sapiens
  Payload ID: 6707
  Gene Symbol: GGT1
  Gene Name: gamma-glutamyltransferase 1
  ENSP ID: ENSP00000387796
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFA

SEQ ID NO: 34051 - protein, 120 aa, Homo sapiens
  Payload ID: 6707
  Gene Symbol: GGT1
  Gene Name: gamma-glutamyltransferase 1
  ENSP ID: ENSP00000389935
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFN

SEQ ID NO: 34052 - protein, 67 aa, Homo sapiens
  Payload ID: 6707
  Gene Symbol: GGT1
  Gene Name: gamma-glutamyltransferase 1
  ENSP ID: ENSP00000393135
MKKKLVVLGLLAVVLVLVIVGLCLWLPSASKEPDNHVYTRAAVAADAKQCSKIGRDALRDGGSAVDA

SEQ ID NO: 34053 - protein, 463 aa, Homo sapiens
  Payload ID: 6707
  Gene Symbol: GGT1
  Gene Name: gamma-glutamyltransferase 1
  ENSP ID: ENSP00000393537
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDVVLYMPSAPLSGPVLALILNILKGYNFSRESVESPEQKGLTYHRIVEAFRFAYAKRTLLGDPKFVDVTEVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDG

SEQ ID NO: 34054 - protein, 174 aa, Homo sapiens
  Payload ID: 6707
  Gene Symbol: GGT1
  Gene Name: gamma-glutamyltransferase 1
  ENSP ID: ENSP00000395271
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGL

SEQ ID NO: 34055 - protein, 111 aa, Homo sapiens
  Payload ID: 6707
  Gene Symbol: GGT1
  Gene Name: gamma-glutamyltransferase 1
  ENSP ID: ENSP00000398589
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAP

SEQ ID NO: 34056 - protein, 126 aa, Homo sapiens
  Payload ID: 6707
  Gene Symbol: GGT1
  Gene Name: gamma-glutamyltransferase 1
  ENSP ID: ENSP00000400621
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQ

SEQ ID NO: 34057 - protein, 37 aa, Homo sapiens
  Payload ID: 6707
  Gene Symbol: GGT1
  Gene Name: gamma-glutamyltransferase 1
  ENSP ID: ENSP00000403826
MKKKLVVLGLLAVVLVLVIVGLCLWLPSASKEPDNHV

SEQ ID NO: 34058 - protein, 80 aa, Homo sapiens
  Payload ID: 6707
  Gene Symbol: GGT1
  Gene Name: gamma-glutamyltransferase 1
  ENSP ID: ENSP00000408151
MKKKLVVLGLLAVVLVLVIVGLCLWLPSASKEPDNHVYTRAAVAADAKQCSKIGRDALRDGGSAVDAAIAALLCVGLMNA

SEQ ID NO: 34059 - protein, 97 aa, Homo sapiens
  Payload ID: 6707
  Gene Symbol: GGT1
  Gene Name: gamma-glutamyltransferase 1
  ENSP ID: ENSP00000415024
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNST

SEQ ID NO: 34060 - protein, 126 aa, Homo sapiens; identical to SEQ ID NO: 34056
  Payload ID: 6707
  Gene Symbol: GGT1
  Gene Name: gamma-glutamyltransferase 1
  ENSP ID: ENSP00000415068

SEQ ID NO: 34061 - protein, 30 aa, Homo sapiens
  Payload ID: 6707
  Gene Symbol: GGT1
  Gene Name: gamma-glutamyltransferase 1
  ENSP ID: ENSP00000415129
MKKKLVVLGLLAVVLVLVIVGLCLWLPSAS

SEQ ID NO: 34062 - protein, 127 aa, Homo sapiens
  Payload ID: 6707
  Gene Symbol: GGT1
  Gene Name: gamma-glutamyltransferase 1
  ENSP ID: ENSP00000415553
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQK

SEQ ID NO: 34063 - protein, 108 aa, Homo sapiens
  Payload ID: 6707
  Gene Symbol: GGT1
  Gene Name: gamma-glutamyltransferase 1
  ENSP ID: ENSP00000417044
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINARE

SEQ ID NO: 34064 - protein, 559 aa, Homo sapiens
  Payload ID: 6708
  Gene Symbol: GGT2
  Gene Name: gamma-glutamyltransferase 2
  ENSP ID: ENSP00000385601
MKKKLVVLGLLAVVLVLVIVGLCLWLPSASKEPDNHVYTRAAMAADAKQCLEIGRDTLRDGGSAVDAAIAALLCVGLMNAHSMGIGVGLFLTIYNSTTRKAEVINAREVAPRLAFASMFNSSEQSQKGGLSVAVPGEIRGYELAHQRHGRLPWARLFQPSIQLARQGFPVGKGLAAVLENKRTVIEQQPVLWYVFCRDRKVLREGERLTLPRLADTYEMLAIEGAQAFYNGSLMAQIVKDIQAAGGIVTAEDLNNYRAELIEHPLNISLGDAVLYMPSARLSGPVLALILNILKGYNFSRESVETPEQKGLTYHRIVEAFRFAYAKRTLLGDPKFVDVTEVVRNMTSEFFAAQLRSQISDHTTHPISYYKPEFYTPDDGGTAHLSVVAEDGSAVSATSTINLYGILFNNEWTTSALPAFTNEFGAPPSPANFIQPGKQPLLSMCLTIMVGQDGQVRMVVGAAGGTQITTDTALAIIYNLWFGYDVKRAVEEPRLHNKLLPNVTTVERNIDQAVTAALETRHHHTQIASTFIAVVQAIVRTAGGWAAASDSRKGGEPAGY

SEQ ID NO: 34065 - protein, 569 aa, Homo sapiens
  Payload ID: 6708
  Gene Symbol: GGT2
  Gene Name: gamma-glutamyltransferase 2
  Uniprot ID: P36268
  ENSP ID: ENSP00000385721
MKKKLVVLGLLAVVLVLVIVGLCLWLPSASKEPDNHVYTRAAMAADAKQCLEIGRDTLRDGGSAVDAAIAALLCVGLMNAHSMGIGVGLFLTIYNSTTRKAEVINAREVAPRLAFASMFNSSEQSQKGGLSVAVPGEIRGYELAHQRHGRLPWARLFQPSIQLARQGFPVGKGLAAVLENKRTVIEQQPVLWYVFCRDRKVLREGERLTLPRLADTYEMLAIEGAQAFYNGSLMAQIVKDIQAAGGIVTAEDLNNYRAELIEHPLNISLGDAVLYMPSARLSGPVLALILNILKGYNFSRESVETPEQKGLTYHRIVEAFRFAYAKRTLLGDPKFVDVTEVVRNMTSEFFAAQLRSQISDHTTHPISYYKPEFYTPDDGGTAHLSVVAEDGSAVSATSTINLYFGSKVCSPVSGILFNNEWTTSALPAFTNEFGAPPSPANFIQPGKQPLLSMCLTIMVGQDGQVRMVVGAAGGTQITTDTALAIIYNLWFGYDVKRAVEEPRLHNKLLPNVTTVERNIDQAVTAALETRHHHTQIASTFIAVVQAIVRTAGGWAAASDSRKGGEPAGY

SEQ ID NO: 34066 - protein, 569 aa, Homo sapiens; identical to SEQ ID NO: 34065
  Payload ID: 6708
  Gene Symbol: GGT2
  Gene Name: gamma-glutamyltransferase 2
  Uniprot ID: P36268
  ENSP ID: ENSP00000402035

SEQ ID NO: 34067 - protein, 554 aa, Homo sapiens
  Payload ID: 6709
  Gene Symbol: GGT5
  Gene Name: gamma-glutamyltransferase 5
  Uniprot ID: P36269
  ENSP ID: ENSP00000263112
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 34068 - protein, 586 aa, Homo sapiens
  Payload ID: 6709
  Gene Symbol: GGT5
  Gene Name: gamma-glutamyltransferase 5
  Uniprot ID: P36269
  ENSP ID: ENSP00000330080
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 34069 - protein, 587 aa, Homo sapiens
  Payload ID: 6709
  Gene Symbol: GGT5
  Gene Name: gamma-glutamyltransferase 5
  Uniprot ID: P36269
  ENSP ID: ENSP00000381340
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPAVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 34070 - protein, 220 aa, Homo sapiens
  Payload ID: 6709
  Gene Symbol: GGT5
  Gene Name: gamma-glutamyltransferase 5
  ENSP ID: ENSP00000402917
  MOD_RES (1)..(1): Any amino acid
XSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQKQDLAALPRLVSNSWPQVILLPQPPKLLALQEVQRGLQDRGQNQTQRPFFLNVVQAVSQEGACVYAVSDLRKSGEAAGY

SEQ ID NO: 34071 - protein, 73 aa, Homo sapiens
  Payload ID: 6709
  Gene Symbol: GGT5
  Gene Name: gamma-glutamyltransferase 5
  ENSP ID: ENSP00000412964
MARGYGATVSLVLLGLGLALAVIVLAVVLSRHQAPCGPQAFAHAAVAADSKVCSDIGRGPVDRGARGAPWLCR

SEQ ID NO: 34072 - protein, 461 aa, Homo sapiens
  Payload ID: 6710
  Gene Symbol: GGT6
  Gene Name: gamma-glutamyltransferase 6
  Uniprot ID: Q6P531
  ENSP ID: ENSP00000301395
MERAEEPVVYQKLLPWEPSLESEEEVEEEETSEALVLNPRRHQDSSRNKAGGLPGTWARVVAALLLLAVGCSLAVRQLQNQGRSTGSLGSVAPPPGGHSHGPGVYHHGAIISPAGAMFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQGQQEPTEHPSTCGQGTLLQVAAHTEHAHVSSVPHACCPFQGF

SEQ ID NO: 34073 - protein, 499 aa, Homo sapiens
  Payload ID: 6710
  Gene Symbol: GGT6
  Gene Name: gamma-glutamyltransferase 6
  ENSP ID: ENSP00000370962
MERAEEPVVYQKLLPWEPSLESEEEVEEEETSEALVLNPRRHQDSSRNKAGGLPGTWARVVAALLLLAVGCSLAVRQLQNQGRSTGSLGSVAPPPGGHSHGPGVYHHGAIISPAATCSHLGRELLVAGGNVVDAGVGAALCLAVVHPHATGLGAMFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQGQQEPTEHPSTCGQGTLLQVAAHTEHAHVSSVPHACCPFQGF

SEQ ID NO: 34074 - protein, 493 aa, Homo sapiens
  Payload ID: 6710
  Gene Symbol: GGT6
  Gene Name: gamma-glutamyltransferase 6
  Uniprot ID: Q6P531
  ENSP ID: ENSP00000458307
MERAEEPVVYQKLLPWEPSLESEEEVEEEETSEALVLNPRRHQDSSRNKAGGLPGTWARVVAALLLLAVGCSLAVRQLQNQGRSTGSLGSVAPPPGGHSHGPGVYHHGAIISPAGRELLVAGGNVVDAGVGAALCLAVVHPHATGLGAMFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQGQQEPTEHPSTCGQGTLLQVAAHTEHAHVSSVPHACCPFQGF

SEQ ID NO: 34075 - protein, 180 aa, Homo sapiens
  Payload ID: 6710
  Gene Symbol: GGT6
  Gene Name: gamma-glutamyltransferase 6
  ENSP ID: ENSP00000459662
MERAEEPVVYQKLLPWEPSLESEEEVEEEETSEALVLNPRRHQDSSRNKAGGLPGTWARVVAALLLLAVGCSLAVRQLQNQGRSTGSLGSVAPPPGGHSHGPGVYHHGAIISPAGRELLVAGGNVVDAGVGAALCLAVVHPHATGLDCCEPREQCPGRRGQQRLCAPSHLLAQLLLWLCT

SEQ ID NO: 34076 - protein, 345 aa, Homo sapiens
  Payload ID: 6710
  Gene Symbol: GGT6
  Gene Name: gamma-glutamyltransferase 6
  ENSP ID: ENSP00000461230
MFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQGQQEPTEHPSTCGQGTLLQVAAHTEHAHVSSVPHACCPFQGF

SEQ ID NO: 34077 - protein, 662 aa, Homo sapiens
  Payload ID: 6711
  Gene Symbol: GGT7
  Gene Name: gamma-glutamyltransferase 7
  Uniprot ID: Q9UJ14
  ENSP ID: ENSP00000338964
MAAENEASQESALGAYSPVDYMSITSFPRLPEDEPAPAAPLRGRKDEDAFLGDPDTDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLGGGGVMLVHDIRRNESHLIDFRESAPGALREETLQRSWETKPGLLVGVPGMVKGLHEAHQLYGRLPWSQVLAFAAAVAQDGFNVTHDLARALAEQLPPNMSERFRETFLPSGRPPLPGSLLHRPDLAEVLDVLGTSGPAAFYAGGNLTLEMVAEAQHAGGVITEEDFSNYSALVEKPVCGVYRGHLVLSPPPPHTGPALISALNILEGFNLTSLVSREQALHWVAETLKIALALASRLGDPVYDSTITESMDDMLSKVEAAYLRGHINDSQAAPAPLLPVYELDGAPTAAQVLIMGPDDFIVAMVSSLNQPFGSGLITPSGILLNSQMLDFSWPNRTANHSAPSLENSVQPGKRPLSFLLPTVVRPAEGLCGTYLALGANGAARGLSGLTQVLLNVLTLNRNLSDSLARGRLHPDLQSNLLQVDSEFTEEEIEFLEARGHHVEKVDVLSWVHGSRRTNNFIIAVKDPRSPDAAGATIL

SEQ ID NO: 34078 - protein, 202 aa, Homo sapiens
  Payload ID: 6711
  Gene Symbol: GGT7
  Gene Name: gamma-glutamyltransferase 7
  ENSP ID: ENSP00000394993
MAAENEASQESALGAYSPVDYMSITSFPRLPEDEPAPAAPLRGRKDEDAFLGDPDTAGHRCPACPGVHAKMRKDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLG

SEQ ID NO: 34079 - protein, 88 aa, Homo sapiens
  Payload ID: 6711
  Gene Symbol: GGT7
  Gene Name: gamma-glutamyltransferase 7
  ENSP ID: ENSP00000486190
  MOD_RES (1)..(1): Any amino acid
XSLNQPFGSGLITPSGILLNSQMLDFSWPNRTANHSAPSLENSVQPGKRPLSFLLPTVVRPAEGLCGTYLALGANGAARGLSGLTQGC

SEQ ID NO: 34080 - protein, 151 aa, Homo sapiens
  Payload ID: 6711
  Gene Symbol: GGT7
  Gene Name: gamma-glutamyltransferase 7
  ENSP ID: ENSP00000486589
  MOD_RES (1)..(1): Any amino acid
XPLLPVYELDGAPTAAQVLIMGPDDFIVAMVSSLNQPFGSGLITPSGILLNSQMLDFSWPNRTANHSAPSLENSVQPGKRPLSFLLPTVVRPAEGLCGTYLALGANGAARGLSGLTQHLNRQPALFRVGFERKGLLFSRTPQNGSMNVLRT

SEQ ID NO: 34081 - protein, 225 aa, Homo sapiens
  Payload ID: 6712
  Gene Symbol: GGTLC1
  Gene Name: gamma-glutamyltransferase light chain 1
  Uniprot ID: Q9BX51
  ENSP ID: ENSP00000278765
MTSEFFSAQLRAQISDDTTHPISYYKPEFYMPDDGGTAHLSVVAEDGSAVSATSTINLYFGSKVRSPVSGILLNNEMDDFSSTSITNEFGVPPSPANFIQPGKQPLSSMCPTIMVGQDGQVRMVVGAAGGTQITMATALAIIYNLWFGYDVKWAVEEPRLHNQLLPNVTTVERNIDQEVTAALETRHHHTQITSTFIAVVQAIVRMAGGWAAASDSRKGGEPAGY

SEQ ID NO: 34082 - protein, 225 aa, Homo sapiens; identical to SEQ ID NO: 34081
  Payload ID: 6712
  Gene Symbol: GGTLC1
  Gene Name: gamma-glutamyltransferase light chain 1
  Uniprot ID: Q9BX51
  ENSP ID: ENSP00000286890

SEQ ID NO: 34083 - protein, 225 aa, Homo sapiens; identical to SEQ ID NO: 34081
  Payload ID: 6712
  Gene Symbol: GGTLC1
  Gene Name: gamma-glutamyltransferase light chain 1
  Uniprot ID: Q9BX51
  ENSP ID: ENSP00000337587

SEQ ID NO: 34084 - protein, 225 aa, Homo sapiens
  Payload ID: 6713
  Gene Symbol: GGTLC2
  Gene Name: gamma-glutamyltransferase light chain 2
  ENSP ID: ENSP00000415676
MTSEFFAAQLRAQISDDTTHPISYYKPEFYTPVDGGTAHLSVVAEDGSAVSATSTINLYFGSKVRSPVSEILFNDEMDDFSSPNITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 34085 - protein, 218 aa, Homo sapiens
  Payload ID: 6713
  Gene Symbol: GGTLC2
  Gene Name: gamma-glutamyltransferase light chain 2
  Uniprot ID: Q14390
  ENSP ID: ENSP00000419751
MTSEFFAAQLRAQISDDTTHPISYYKPEFYTPVDGGTAHLSVVAEDGSAVSATSTINLYFGSKVRSPVSEILFNDEMDDFSSPNITNEFGVPPSPANFIQPGKQPLSSMCPTIMVGQDGQPPSHADHTPMPQAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 34086 - protein, 225 aa, Homo sapiens; identical to SEQ ID NO: 34084
  Payload ID: 6713
  Gene Symbol: GGTLC2
  Gene Name: gamma-glutamyltransferase light chain 2
  ENSP ID: ENSP00000478615

SEQ ID NO: 34087 - protein, 225 aa, Homo sapiens; identical to SEQ ID NO: 34084
  Payload ID: 6713
  Gene Symbol: GGTLC2
  Gene Name: gamma-glutamyltransferase light chain 2
  ENSP ID: ENSP00000483019

SEQ ID NO: 34088 - protein, 225 aa, Homo sapiens
  Payload ID: 6714
  Gene Symbol: GGTLC3
  Gene Name: gamma-glutamyltransferase light chain 3
  Uniprot ID: B5MD39
  ENSP ID: ENSP00000477856
MTSEFFAAQLRSQISDHTTHPISYYKPEFYTPDDGGTAHLSVVAEDGSAVSATSTINLYFGSKVCSPVSGILFNNEWTTSALPAFTNEFGAPPSPANFIQPGKQPLLSMCPTIMVGQDGQVRMVVGAAGGTQITTDTALAIIYNLWFGYDVKRAVEEPRLHNKLLPNVTTVERNIDQAVTAALETRHHHTQIASTFIAVVQAIVRTAGGWAAASDSRKGGEPAGY

SEQ ID NO: 34089 - protein, 854 aa, Homo sapiens
  Payload ID: 6715
  Gene Symbol: GSAP
  Gene Name: gamma-secretase activating protein
  Uniprot ID: A4D1B5
  ENSP ID: ENSP00000257626
MALRLVADFDLGKDVLPWLRAQRAVSEASGAGSGGADVLENDYESLHVLNVERNGNIIYTYKDDKGNVVFGLYDCQTRQNELLYTFEKDLQVFSCSVNSERTLLAASLVQSTKEGKRNELQPGSKCLTLLVEIHPVNNVKVLKAVDSYIWVQFLYPHIESHPLPENHLLLISEEKYIEQFRIHVAQEDGNRVVIKNSGHLPRDRIAEDFVWAQWDMSEQRLYYIDLKKSRSILKCIQFYADESYNLMFEVPLDISLSNSGFKLVNFGCDYHQYRDKFSKHLTLCVFTNHTGSLCVCYSPKCASWGQITYSVFYIHKGHSKTFTTSLENVGSHMTKGITFLNLDYYVAVYLPGHFFHLLNVQHPDLICHNLFLTGNNEMIDMLPHCPLQSLSGSLVLDCCSGKLYRALLSQSSLLQLLQNTCLDCEKMAALHCALYCGQGAQFLEAQIIQWISENVSACHSFDLIQEFIIASSYWSVYSETSNMDKLLPHSSVLTWNTEIPGITLVTEDIALPLMKVLSFKGYWEKLNSNLEYVKYAKPHFHYNNSVVRREWHNLISEEKTGKRRSAAYVRNILDNAVKVISNLEARNLGPRLTPLLQEEDSHQRLLMGLMVSELKDHFLRHLQGVEKKKIEQMVLDYISKLLDLICHIVETNWRKHNLHSWVLHFNSRGSAAEFAVFHIMTRILEATNSLFLPLPPGFHTLHTILGVQCLPLHNLLHCIDSGVLLLTETAVIRLMKDLDNTEKNEKLKFSIIVRLPPLIGQKICRLWDHPMSSNIISRNHVTRLLQNYKKQPRNSMINKSSFSVEFLPLNYFIEILTDIESSNQALYPFEGHDNVDAEFVEEAALKHTAMLLGL

SEQ ID NO: 34090 - protein, 188 aa, Homo sapiens
  Payload ID: 6715
  Gene Symbol: GSAP
  Gene Name: gamma-secretase activating protein
  ENSP ID: ENSP00000396230
VLSFKGYWEKLNSNLEYVKYAKPHFHYNNSVVRREWHNLISEEKTGKRRSAAYVRNILDNAVKVISNLEARNLGPRLTPLLQEEDSHQRLLMGLLDLICHIVETNWRKHNLHSWVLHFNSRGSAAEFAVFHIMTRILEATNSLFLPLPPGFHTLHTILGVQCLPLHNLLHCIDSGVLLLTETAVIRLM

SEQ ID NO: 34091 - protein, 58 aa, Homo sapiens
  Payload ID: 6715
  Gene Symbol: GSAP
  Gene Name: gamma-secretase activating protein
  ENSP ID: ENSP00000402748
MLKEMEILFIPIRMIREMSSLDYMIVKPDKMSFYIPLRKTCKFSVALSTVKGLCLLQV

SEQ ID NO: 34092 - protein, 175 aa, Homo sapiens
  Payload ID: 6715
  Gene Symbol: GSAP
  Gene Name: gamma-secretase activating protein
  ENSP ID: ENSP00000415402
MTRILEATNSLFLPLPPGFHTLHTILGVQCLPLHNLLHCIDSGVLLLTETAVIRLMKDLDNTEKNEKLKFSIIVRLPPLIGQKICRLWDHPMSSNIISRNHVTRLLQNYKKQPRNSMINKSSFSVEFLPLNYFIEILTDIESSNQALYPFEGHDNVDAEFVEEAALKHTAMLLGL

SEQ ID NO: 34093 - protein, 358 aa, Homo sapiens
  Payload ID: 6716
  Gene Symbol: GDAP1
  Gene Name: ganglioside induced differentiation associated protein 1
  Uniprot ID: Q8TB36
  ENSP ID: ENSP00000220822
MAERQEEQRGSPPLRAEGKADAEVKLILYHWTHSFSSQKVRLVIAEKALKCEEHDVSLPLSEHNEPWFMRLNSTGEVPVLIHGENIICEATQIIDYLEQTFLDERTPRLMPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 34094 - protein, 290 aa, Homo sapiens
  Payload ID: 6716
  Gene Symbol: GDAP1
  Gene Name: ganglioside induced differentiation associated protein 1
  Uniprot ID: Q8TB36
  ENSP ID: ENSP00000417006
MRLNSTGEVPVLIHGENIICEATQIIDYLEQTFLDERTPRLMPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 34095 - protein, 60 aa, Homo sapiens
  Payload ID: 6716
  Gene Symbol: GDAP1
  Gene Name: ganglioside induced differentiation associated protein 1
  ENSP ID: ENSP00000430136
MAERQEEQRGSPPLRAEGKADAEVKLILYHWTHSFSSQKVRLVIAEKALKCEEHDKEHPG

SEQ ID NO: 34096 - protein, 367 aa, Homo sapiens
  Payload ID: 6717
  Gene Symbol: GDAP1L1
  Gene Name: ganglioside induced differentiation associated protein 1-like 1
  Uniprot ID: Q96MZ0
  ENSP ID: ENSP00000341782
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 34097 - protein, 147 aa, Homo sapiens
  Payload ID: 6717
  Gene Symbol: GDAP1L1
  Gene Name: ganglioside induced differentiation associated protein 1-like 1
  Uniprot ID: Q96MZ0
  ENSP ID: ENSP00000362043
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGGPRLAASLELRGANPRGQLGRAQ

SEQ ID NO: 34098 - protein, 123 aa, Homo sapiens
  Payload ID: 6717
  Gene Symbol: GDAP1L1
  Gene Name: ganglioside induced differentiation associated protein 1-like 1
  ENSP ID: ENSP00000391714
LEHDDVSYLKKILGELAMVLDQIEAELEKRKLENEGQKCELWLCGCAFTLADVLLGATLHRLKFLGLSKKYWEDGSRPNLQSFFERVQRRFAFRKVSRWNCGDWLGSEGTLPQDKADIKTQLL

SEQ ID NO: 34099 - protein, 288 aa, Homo sapiens
  Payload ID: 6717
  Gene Symbol: GDAP1L1
  Gene Name: ganglioside induced differentiation associated protein 1-like 1
  ENSP ID: ENSP00000392881
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGGHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASF

SEQ ID NO: 34100 - protein, 251 aa, Homo sapiens
  Payload ID: 6717
  Gene Symbol: GDAP1L1
  Gene Name: ganglioside induced differentiation associated protein 1-like 1
  ENSP ID: ENSP00000404128
  MOD_RES (1)..(1): Any amino acid
XSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGGCQPWGRWGLQPTQPTLPLPSLSLFFPQKSQRTSQVVKRMGYGVRLRFKS

SEQ ID NO: 34101 - protein, 386 aa, Homo sapiens
  Payload ID: 6717
  Gene Symbol: GDAP1L1
  Gene Name: ganglioside induced differentiation associated protein 1-like 1
  Uniprot ID: Q96MZ0
  ENSP ID: ENSP00000440498
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGGGRGRCPSGFPAQPLAVPTEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 34102 - protein, 278 aa, Homo sapiens
  Payload ID: 6717
  Gene Symbol: GDAP1L1
  Gene Name: ganglioside induced differentiation associated protein 1-like 1
  ENSP ID: ENSP00000478701
MRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 34103 - protein, 296 aa, Homo sapiens
  Payload ID: 6717
  Gene Symbol: GDAP1L1
  Gene Name: ganglioside induced differentiation associated protein 1-like 1
  ENSP ID: ENSP00000480502
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 34104 - protein, 364 aa, Homo sapiens
  Payload ID: 6717
  Gene Symbol: GDAP1L1
  Gene Name: ganglioside induced differentiation associated protein 1-like 1
  ENSP ID: ENSP00000483113
MATPNNLTPTNCSWWPISALESDGQASGGPRRSRGGQPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLARTGAAVPELLDALPMDAYTHGCILHPELTTDSMIPKYATAEIRRHLANATTDLMKLDHEEEPQLSEPYLSKQKKLMAKILEHDDVSYLKKILGELAMVLDQIEGAGEEEAGERGAEMRAVALWLCLHLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 34105 - protein, 496 aa, Homo sapiens
  Payload ID: 6718
  Gene Symbol: GDAP2
  Gene Name: ganglioside induced differentiation associated protein 2
  Uniprot ID: Q9NXN4
  ENSP ID: ENSP00000358450
MDPLGAPSQFVDVDTLPSWGDSCQDELNSSDTTAEIFQEDTVRSPFLYNKDVNGKVVLWKGDVALLNCTAIVNTSNESLTDKNPVSESIFMLAGPDLKEDLQKLKGCRTGEAKLTKGFNLAARFIIHTVGPKYKSRYRTAAESSLYSCYRNVLQLAKEQSMSSVGFCVINSAKRGYPLEDATHIALRTVRRFLEIHGETIEKVVFAVSDLEEGTYQKLLPLYFPRSLKEENRSLPYLPADIGNAEGEPVVPERQIRISEKPGAPEDNQEEEDEGLGVDLSFIGSHAFARMEGDIDKQRKLILQGQLSEAALQKQHQRNYNRWLCQARSEDLSDIASLKALYQTGVDNCGRTVMVVVGRNIPVTLIDMDKALLYFIHVMDHIAVKEYVLVYFHTLTSEYNHLDSDFLKKLYDVVDVKYKRNLKAVYFVHPTFRSKVSTWFFTTFSVSGLKDKIHHVDSLHQLFSAISPEQIDFPPFVLEYDARVRSTRSSPSPGMVY

SEQ ID NO: 34106 - protein, 497 aa, Homo sapiens
  Payload ID: 6718
  Gene Symbol: GDAP2
  Gene Name: ganglioside induced differentiation associated protein 2
  Uniprot ID: Q9NXN4
  ENSP ID: ENSP00000358451
MDPLGAPSQFVDVDTLPSWGDSCQDELNSSDTTAEIFQEDTVRSPFLYNKDVNGKVVLWKGDVALLNCTAIVNTSNESLTDKNPVSESIFMLAGPDLKEDLQKLKGCRTGEAKLTKGFNLAARFIIHTVGPKYKSRYRTAAESSLYSCYRNVLQLAKEQSMSSVGFCVINSAKRGYPLEDATHIALRTVRRFLEIHGETIEKVVFAVSDLEEGTYQKLLPLYFPRSLKEENRSLPYLPADIGNAEGEPVVPERQIRISEKPGAPEDNQEEEDEGLGVDLSFIGSHAFARMEGDIDKQRKLILQGQLSEAALQKQHQRNYNRWLCQARSEDLSDIASLKALYQTGVDNCGRTVMVVVGRNIPVTLIDMDKALLYFIHVMDHIAVKEYVLVYFHTLTSEYNHLDSDFLKKLYDVVDVKYKRNLKAVYFVHPTFRSKVSTWFFTTFSVSGLKDKIHHVDSLHQLFSAISPEQIDFPPFVLEYDARENGPYYTSYPPSPDL

SEQ ID NO: 34107 - protein, 382 aa, Homo sapiens
  Payload ID: 6719
  Gene Symbol: GJA1
  Gene Name: gap junction protein, alpha 1, 43kDa
  Uniprot ID: P17302
  ENSP ID: ENSP00000282561
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 34108 - protein, 543 aa, Homo sapiens
  Payload ID: 6720
  Gene Symbol: GJA10
  Gene Name: gap junction protein, alpha 10, 62kDa
  Uniprot ID: Q969M2
  ENSP ID: ENSP00000358358
MGDWNLLGGILEEVHSHSTIVGKIWLTILFIFRMLVLRVAAEDVWDDEQSAFACNTRQPGCNNICYDDAFPISLIRFWVLQIIFVSSPSLVYMGHALYRLRAFEKDRQRKKSHLRAQMENPDLDLEEQQRIDRELRRLEEQKRIHKVPLKGCLLRTYVLHILTRSVLEVGFMIGQYILYGFQMHPLYKCTQPPCPNAVDCFVSRPTEKTIFMLFMHSIAAISLLLNILEIFHLGIRKIMRTLYKKSSSEGIEDETGPPFHLKKYSVAQQCMICSSLPERISPLQANNQQQVIRVNVPKSKTMWQIPQPRQLEVDPSNGKKDWSEKDQHSGQLHVHSPCPWAGSAGNQHLGQQSDHSSFGLQNTMSQSWLGTTTAPRNCPSFAVGTWEQSQDPEPSGEPLTDLHSHCRDSEGSMRESGVWIDRSRPGSRKASFLSRLLSEKRHLHSDSGSSGSRNSSCLDFPHWENSPSPLPSVTGHRTSMVRQAALPIMELSQELFHSGCFLFPFFLPGVCMYVCVDREADGGGDYLWRDKIIHSIHSVKFNS

SEQ ID NO: 34109 - protein, 435 aa, Homo sapiens
  Payload ID: 6721
  Gene Symbol: GJA3
  Gene Name: gap junction protein, alpha 3, 46kDa
  Uniprot ID: Q9Y6H8
  ENSP ID: ENSP00000241125
MGDWSFLGRLLENAQEHSTVIGKVWLTVLFIFRILVLGAAAEDVWGDEQSDFTCNTQQPGCENVCYDRAFPISHIRFWALQIIFVSTPTLIYLGHVLHIVRMEEKKKEREEEEQLKRESPSPKEPPQDNPSSRDDRGRVRMAGALLRTYVFNIIFKTLFEVGFIAGQYFLYGFELKPLYRCDRWPCPNTVDCFISRPTEKTIFIIFMLAVACASLLLNMLEIYHLGWKKLKQGVTSRLGPDASEAPLGTADPPPLPPSSRPPAVAIGFPPYYAHTAAPLGQARAVGYPGAPPPAADFKLLALTEARGKGQSAKLYNGHHHLLMTEQNWANQAAERQPPALKAYPAASTPAAPSPVGSSSPPLAHEAEAGAAPLLLDGSGSSLEGSALAGTPEEEEQAVTTAAQMHQPPLPLGDPGRASKASRASSGRARPEDLAI

SEQ ID NO: 34110 - protein, 333 aa, Homo sapiens
  Payload ID: 6722
  Gene Symbol: GJA4
  Gene Name: gap junction protein, alpha 4, 37kDa
  Uniprot ID: P35212
  ENSP ID: ENSP00000343676
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWANLTTEERLASSRPPLFLDPPPQNGQKPPSRPSSSASKKQYV

SEQ ID NO: 34111 - protein, 292 aa, Homo sapiens
  Payload ID: 6722
  Gene Symbol: GJA4
  Gene Name: gap junction protein, alpha 4, 37kDa
  ENSP ID: ENSP00000409186
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWA

SEQ ID NO: 34112 - protein, 251 aa, Homo sapiens
  Payload ID: 6723
  Gene Symbol: GJA5
  Gene Name: gap junction protein, alpha 5, 40kDa
  ENSP ID: ENSP00000407645
MGDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLS

SEQ ID NO: 34113 - protein, 358 aa, Homo sapiens
  Payload ID: 6723
  Gene Symbol: GJA5
  Gene Name: gap junction protein, alpha 5, 40kDa
  Uniprot ID: P36382
  ENSP ID: ENSP00000463851
MGDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLSGPSVGIVQSCTPPPDFNQCLENGPGGKFFNPFSNNMASQQNTDNLVTEQVRGQEQTPGEGFIQVRYGQKPEVPNGVSPGHRLPHGYHSDKRRLSKASSKARSDDLSV

SEQ ID NO: 34114 - protein, 358 aa, Homo sapiens; identical to SEQ ID NO: 34113
  Payload ID: 6723
  Gene Symbol: GJA5
  Gene Name: gap junction protein, alpha 5, 40kDa
  Uniprot ID: P36382
  ENSP ID: ENSP00000484552

SEQ ID NO: 34115 - protein, 433 aa, Homo sapiens
  Payload ID: 6724
  Gene Symbol: GJA8
  Gene Name: gap junction protein, alpha 8, 50kDa
  Uniprot ID: P48165
  ENSP ID: ENSP00000358238
MGDWSFLGNILEEVNEHSTVIGRVWLTVLFIFRILILGTAAEFVWGDEQSDFVCNTQQPGCENVCYDEAFPISHIRLWVLQIIFVSTPSLMYVGHAVHYVRMEEKRKSREAEELGQQAGTNGGPDQGSVKKSSGSKGTKKFRLEGTLLRTYICHIIFKTLFEVGFIVGHYFLYGFRILPLYRCSRWPCPNVVDCFVSRPTEKTIFILFMLSVASVSLFLNVMELGHLGLKGIRSALKRPVEQPLGEIPEKSLHSIAVSSIQKAKGYQLLEEEKIVSHYFPLTEVGMVETSPLPAKPFNQFEEKISTGPLGDLSRGYQETLPSYAQVGAQEVEGEGPPAEEGAEPEVGEKKEEAERLTTEEQEKVAVPEGEKVETPGVDKEGEKEEPQSEKVSKQGLPAEKTPSLCPELTTDDARPLSRLSKASSRARSDDLTV

SEQ ID NO: 34116 - protein, 515 aa, Homo sapiens
  Payload ID: 6725
  Gene Symbol: GJA9
  Gene Name: gap junction protein, alpha 9, 59kDa
  Uniprot ID: P57773
  ENSP ID: ENSP00000350415
MGDWNLLGDTLEEVHIHSTMIGKIWLTILFIFRMLVLGVAAEDVWNDEQSGFICNTEQPGCRNVCYDQAFPISLIRYWVLQVIFVSSPSLVYMGHALYRLRVLEEERQRMKAQLRVELEEVEFEMPRDRRRLEQELCQLEKRKLNKAPLRGTLLCTYVIHIFTRSVVEVGFMIGQYLLYGFHLEPLFKCHGHPCPNIIDCFVSRPTEKTIFLLFMQSIATISLFLNILEIFHLGFKKIKRGLWGKYKLKKEHNEFHANKAKQNVAKYQSTSANSLKRLPSAPDYNLLVEKQTHTAVYPSLNSSSVFQPNPDNHSVNDEKCILDEQETVLSNEISTLSTSCSHFQHISSNNNKDTHKIFGKELNGNQLMEKRETEGKDSKRNYYSRGHRSIPGVAIDGENNMRQSPQTVFSLPANCDWKPRWLRATWGSSTEHENRGSPPKGNLKGQFRKGTVRTLPPSQGDSQSLDIPNTADSLGGLSFEPGLVRTCNNPVCPPNHVVSLTNNLIGRRVPTDLQI

SEQ ID NO: 34117 - protein, 515 aa, Homo sapiens; identical to SEQ ID NO: 34116
  Payload ID: 6725
  Gene Symbol: GJA9
  Gene Name: gap junction protein, alpha 9, 59kDa
  Uniprot ID: P57773
  ENSP ID: ENSP00000354020

SEQ ID NO: 34118 - protein, 283 aa, Homo sapiens
  Payload ID: 6726
  Gene Symbol: GJB1
  Gene Name: gap junction protein, beta 1, 32kDa
  Uniprot ID: P08034
  ENSP ID: ENSP00000354900
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKCDVYPCPNTVDCFVSRPTEKTVFTVFMLAASGICIILNVAEVVYLIIRACARRAQRRSNPPSRKGSGFGHRLSPEYKQNEINKLLSEQDGSLKDILRRSPGTGAGLAEKSDRCSAC

SEQ ID NO: 34119 - protein, 283 aa, Homo sapiens; identical to SEQ ID NO: 34118
  Payload ID: 6726
  Gene Symbol: GJB1
  Gene Name: gap junction protein, beta 1, 32kDa
  Uniprot ID: P08034
  ENSP ID: ENSP00000363134

SEQ ID NO: 34120 - protein, 283 aa, Homo sapiens; identical to SEQ ID NO: 34118
  Payload ID: 6726
  Gene Symbol: GJB1
  Gene Name: gap junction protein, beta 1, 32kDa
  Uniprot ID: P08034
  ENSP ID: ENSP00000363141

SEQ ID NO: 34121 - protein, 84 aa, Homo sapiens
  Payload ID: 6726
  Gene Symbol: GJB1
  Gene Name: gap junction protein, beta 1, 32kDa
  ENSP ID: ENSP00000407223
MNWTGLYTLLSGVNRHSTAIGRVWLSVIFIFRIMVLVVAAESVWGDEKSSFICNTLQPGCNSVCYDQFFPISHVRLWSLQLILV

SEQ ID NO: 34122 - protein, 226 aa, Homo sapiens
  Payload ID: 6727
  Gene Symbol: GJB2
  Gene Name: gap junction protein, beta 2, 26kDa
  Uniprot ID: P29033
  ENSP ID: ENSP00000372295
MDWGTLQTILGGVNKHSTSIGKIWLTVLFIFRIMILVVAAKEVWGDEQADFVCNTLQPGCKNVCYDHYFPISHIRLWALQLIFVSTPALLVAMHVAYRRHEKKRKFIKGEIKSEFKDIEEIKTQKVRIEGSLWWTYTSSIFFRVIFEAAFMYVFYVMYDGFSMQRLVKCNAWPCPNTVDCFVSRPTEKTVFTVFMIAVSGICILLNVTELCYLLIRYCSGKSKKPV

SEQ ID NO: 34123 - protein, 226 aa, Homo sapiens; identical to SEQ ID NO: 34122
  Payload ID: 6727
  Gene Symbol: GJB2
  Gene Name: gap junction protein, beta 2, 26kDa
  Uniprot ID: P29033
  ENSP ID: ENSP00000372299

SEQ ID NO: 34124 - protein, 270 aa, Homo sapiens
  Payload ID: 6728
  Gene Symbol: GJB3
  Gene Name: gap junction protein, beta 3, 31kDa
  Uniprot ID: O75712
  ENSP ID: ENSP00000362460
MDWKTLQALLSGVNKYSTAFGRIWLSVVFVFRVLVYVVAAERVWGDEQKDFDCNTKQPGCTNVCYDNYFPISNIRLWALQLIFVTCPSLLVILHVAYREERERRHRQKHGDQCAKLYDNAGKKHGGLWWTYLFSLIFKLIIEFLFLYLLHTLWHGFNMPRLVQCANVAPCPNIVDCYIARPTEKKIFTYFMVGASAVCIVLTICELCYLICHRVLRGLHKDKPRGGCSPSSSASRASTCRCHHKLVEAGEVDPDPGNNKLQASAPNLTPI

SEQ ID NO: 34125 - protein, 270 aa, Homo sapiens; identical to SEQ ID NO: 34124
  Payload ID: 6728
  Gene Symbol: GJB3
  Gene Name: gap junction protein, beta 3, 31kDa
  Uniprot ID: O75712
  ENSP ID: ENSP00000362464

SEQ ID NO: 34126 - protein, 266 aa, Homo sapiens
  Payload ID: 6729
  Gene Symbol: GJB4
  Gene Name: gap junction protein, beta 4, 30.3kDa
  Uniprot ID: Q9NTQ9
  ENSP ID: ENSP00000345868
MNWAFLQGLLSGVNKYSTVLSRIWLSVVFIFRVLVYVVAAEEVWDDEQKDFVCNTKQPGCPNVCYDEFFPVSHVRLWALQLILVTCPSLLVVMHVAYREERERKHHLKHGPNAPSLYDNLSKKRGGLWWTYLLSLIFKAAVDAGFLYIFHRLYKDYDMPRVVACSVEPCPHTVDCYISRPTEKKVFTYFMVTTAAICILLNLSEVFYLVGKRCMEIFGPRHRRPRCRECLPDTCPPYVLSQGGHPEDGNSVLMKAGSAPVDAGGYP

SEQ ID NO: 34127 - protein, 273 aa, Homo sapiens
  Payload ID: 6730
  Gene Symbol: GJB5
  Gene Name: gap junction protein, beta 5, 31.1kDa
  Uniprot ID: O95377
  ENSP ID: ENSP00000340811
MNWSIFEGLLSGVNKYSTAFGRIWLSLVFIFRVLVYLVTAERVWSDDHKDFDCNTRQPGCSNVCFDEFFPVSHVRLWALQLILVTCPSLLVVMHVAYREVQEKRHREAHGENSGRLYLNPGKKRGGLWWTYVCSLVFKASVDIAFLYVFHSFYPKYILPPVVKCHADPCPNIVDCFISKPSEKNIFTLFMVATAAICILLNLVELIYLVSKRCHECLAARKAQAMCTGHHPHGTTSSCKQDDLLSGDLIFLGSDSHPPLLPDRPRDHVKKTIL

SEQ ID NO: 34128 - protein, 261 aa, Homo sapiens
  Payload ID: 6731
  Gene Symbol: GJB6
  Gene Name: gap junction protein, beta 6, 30kDa
  Uniprot ID: O95452
  ENSP ID: ENSP00000241124
MDWGTLHTFIGGVNKHSTSIGKVWITVIFIFRVMILVVAAQEVWGDEQEDFVCNTLQPGCKNVCYDHFFPVSHIRLWALQLIFVSTPALLVAMHVAYYRHETTRKFRRGEKRNDFKDIEDIKKQKVRIEGSLWWTYTSSIFFRIIFEAAFMYVFYFLYNGYHLPWVLKCGIDPCPNLVDCFISRPTEKTVFTIFMISASVICMLLNVAELCYLLLKVCFRRSKRAQTQKNHPNHALKESKQNEMNELISDSGQNAITGFPS

SEQ ID NO: 34129 - protein, 261 aa, Homo sapiens; identical to SEQ ID NO: 34128
  Payload ID: 6731
  Gene Symbol: GJB6
  Gene Name: gap junction protein, beta 6, 30kDa
  Uniprot ID: O95452
  ENSP ID: ENSP00000348521

SEQ ID NO: 34130 - protein, 261 aa, Homo sapiens; identical to SEQ ID NO: 34128
  Payload ID: 6731
  Gene Symbol: GJB6
  Gene Name: gap junction protein, beta 6, 30kDa
  Uniprot ID: O95452
  ENSP ID: ENSP00000382938

SEQ ID NO: 34131 - protein, 261 aa, Homo sapiens; identical to SEQ ID NO: 34128
  Payload ID: 6731
  Gene Symbol: GJB6
  Gene Name: gap junction protein, beta 6, 30kDa
  Uniprot ID: O95452
  ENSP ID: ENSP00000382939

SEQ ID NO: 34132 - protein, 223 aa, Homo sapiens
  Payload ID: 6732
  Gene Symbol: GJB7
  Gene Name: gap junction protein, beta 7, 25kDa
  Uniprot ID: Q6PEY0
  ENSP ID: ENSP00000296882
MSWMFLRDLLSGVNKYSTGTGWIWLAVVFVFRLLVYMVAAEHVWKDEQKEFECNSRQPGCKNVCFDDFFPISQVRLWALQLIMVSTPSLLVVLHVAYHEGREKRHRKKLYVSPGTMDGGLWYAYLISLIVKTGFEIGFLVLFYKLYDGFSVPYLIKCDLKPCPNTVDCFISKPTEKTIFILFLVITSCLCIVLNFIELSFLVLKCFIKCCLQKYLKKPQVLSV

SEQ ID NO: 34133 - protein, 162 aa, Homo sapiens
  Payload ID: 6732
  Gene Symbol: GJB7
  Gene Name: gap junction protein, beta 7, 25kDa
  ENSP ID: ENSP00000358589
MSWMFLRDLLSGVNKYSTGTGWIWLAVVFVFRLLVYMVAAEHVWKDEQKEFECNSRQPGCKNVCFDDFFPISQVRLWALQLIMVSTPSLLVVLHVAYHEGREKRHRKKLYVSPGTMDGGLWYAYLISLIVKTGFEIGFLVLFYKLYDGFSVPYLIKCDLKPC

SEQ ID NO: 34134 - protein, 223 aa, Homo sapiens; identical to SEQ ID NO: 34132
  Payload ID: 6732
  Gene Symbol: GJB7
  Gene Name: gap junction protein, beta 7, 25kDa
  Uniprot ID: Q6PEY0
  ENSP ID: ENSP00000435355

SEQ ID NO: 34135 - protein, 321 aa, Homo sapiens
  Payload ID: 6733
  Gene Symbol: GJD2
  Gene Name: gap junction protein, delta 2, 36kDa
  Uniprot ID: Q9UKL4
  ENSP ID: ENSP00000290374
MGEWTILERLLEAAVQQHSTMIGRILLTVVVIFRILIVAIVGETVYDDEQTMFVCNTLQPGCNQACYDRAFPISHIRYWVFQIIMVCTPSLCFITYSVHQSAKQRERRYSTVFLALDRDPPESIGGPGGTGGGGSGGGKREDKKLQNAIVNGVLQNTENTSKETEPDCLEVKELTPHPSGLRTASKSKLRRQEGISRFYIIQVVFRNALEIGFLVGQYFLYGFSVPGLYECNRYPCIKEVECYVSRPTEKTVFLVFMFAVSGICVVLNLAELNHLGWRKIKLAVRGAQAKRKSIYEIRNKDLPRVSVPNFGRTQSSDSAYV

SEQ ID NO: 34136 - protein, 294 aa, Homo sapiens
  Payload ID: 6734
  Gene Symbol: GJD3
  Gene Name: gap junction protein, delta 3, 31.9kDa
  Uniprot ID: Q8N144
  ENSP ID: ENSP00000463752
MGEWAFLGSLLDAVQLQSPLVGRLWLVVMLIFRILVLATVGGAVFEDEQEEFVCNTLQPGCRQTCYDRAFPVSHYRFWLFHILLLSAPPVLFVVYSMHRAGKEAGGAEAAAQCAPGLPEAQCAPCALRARRARRCYLLSVALRLLAELTFLGGQALLYGFRVAPHFACAGPPCPHTVDCFVSRPTEKTVFVLFYFAVGLLSALLSVAELGHLLWKGRPRAGERDNRCNRAHEEAQKLLPPPPPPPPPPALPSRRPGPEPCAPPAYAHPAPASLRECGSGRGKASPATGRRDLAI

SEQ ID NO: 34137 - protein, 370 aa, Homo sapiens
  Payload ID: 6735
  Gene Symbol: GJD4
  Gene Name: gap junction protein, delta 4, 40.1kDa
  Uniprot ID: Q96KN9
  ENSP ID: ENSP00000315070
MEGVDLLGFLIITLNCNVTMVGKLWFVLTMLLRMLVIVLAGRPVYQDEQERFVCNTLQPGCANVCYDVFSPVSHLRFWLIQGVCVLLPSAVFSVYVLHRGATLAALGPRRCPDPREPASGQRRCPRPFGERGGLQVPDFSAGYIIHLLLRTLLEAAFGALHYFLFGFLAPKKFPCTRPPCTGVVDCYVSRPTEKSLLMLFLWAVSALSFLLGLADLVCSLRRRMRRRPGPPTSPSIRKQSGASGHAEGRRTDEEGGREEEGAPAPPGARAGGEGAGSPRRTSRVSGHTKIPDEDESEVTSSASEKLGRQPRGRPHREAAQDPRGSGSEEQPSAAPSRLAAPPSCSSLQPPDPPASSSGAPHLRARKSEWV

SEQ ID NO: 34138 - protein, 205 aa, Homo sapiens
  Payload ID: 6736
  Gene Symbol: GJE1
  Gene Name: gap junction protein, epsilon 1, 23kDa
  Uniprot ID: A6NN92
  ENSP ID: ENSP00000455469
MSLNYIKNFYEGCVKPPTVIGQFHTLFFGSIRIFFLGVLGFAVYGNEALHFICDPDKREVNLFCYNQFRPITPQVSFSALQLVIVLVPGALFHLYAACKSINQECILQKPIYTIIYILSVLLRISLAAIAFWLQIYLFGFQVKSLYLCDARSLGENMIIRCMVPEHFEKTIFLIAINTFTTITILLFVAEIFEIIFRRLYFPFRQ

SEQ ID NO: 34139 - protein, 396 aa, Homo sapiens
  Payload ID: 6737
  Gene Symbol: GJC1
  Gene Name: gap junction protein, gamma 1, 45kDa
  Uniprot ID: P36383
  ENSP ID: ENSP00000333193
MSWSFLTRLLEEIHNHSTFVGKIWLTVLIVFRIVLTAVGGESIYYDEQSKFVCNTEQPGCENVCYDAFAPLSHVRFWVFQIILVATPSVMYLGYAIHKIAKMEHGEADKKAARSKPYAMRWKQHRALEETEEDNEEDPMMYPEMELESDKENKEQSQPKPKHDGRRRIREDGLMKIYVLQLLARTVFEVGFLIGQYFLYGFQVHPFYVCSRLPCPHKIDCFISRPTEKTIFLLIMYGVTGLCLLLNIWEMLHLGFGTIRDSLNSKRRELEDPGAYNYPFTWNTPSAPPGYNIAVKPDQIQYTELSNAKIAYKQNKANTAQEQQYGSHEENLPADLEALQREIRMAQERLDLAVQAYSHQNNPHGPREKKAKVGSKAGSNKSTASSKSGDGKTSVWI

SEQ ID NO: 34140 - protein, 396 aa, Homo sapiens; identical to SEQ ID NO: 34139
  Payload ID: 6737
  Gene Symbol: GJC1
  Gene Name: gap junction protein, gamma 1, 45kDa
  Uniprot ID: P36383
  ENSP ID: ENSP00000411528

SEQ ID NO: 34141 - protein, 396 aa, Homo sapiens; identical to SEQ ID NO: 34139
  Payload ID: 6737
  Gene Symbol: GJC1
  Gene Name: gap junction protein, gamma 1, 45kDa
  Uniprot ID: P36383
  ENSP ID: ENSP00000466339

SEQ ID NO: 34142 - protein, 103 aa, Homo sapiens
  Payload ID: 6737
  Gene Symbol: GJC1
  Gene Name: gap junction protein, gamma 1, 45kDa
  ENSP ID: ENSP00000466392
MSWSFLTRLLEEIHNHSTFVGKIWLTVLIVFRIVLTAVGGESIYYDEQSKFVCNTEQPGCENVCYDAFAPLSHVRFWVFQIILVATPSVMYLGYAIHKIAKME

SEQ ID NO: 34143 - protein, 70 aa, Homo sapiens
  Payload ID: 6737
  Gene Symbol: GJC1
  Gene Name: gap junction protein, gamma 1, 45kDa
  ENSP ID: ENSP00000467090
MSWSFLTRLLEEIHNHSTFVGKIWLTVLIVFRIVLTAVGGESIYYDEQSKFVCNTEQPGCENVCYDAFAP

SEQ ID NO: 34144 - protein, 396 aa, Homo sapiens; identical to SEQ ID NO: 34139
  Payload ID: 6737
  Gene Symbol: GJC1
  Gene Name: gap junction protein, gamma 1, 45kDa
  Uniprot ID: P36383
  ENSP ID: ENSP00000467201

SEQ ID NO: 34145 - protein, 72 aa, Homo sapiens
  Payload ID: 6737
  Gene Symbol: GJC1
  Gene Name: gap junction protein, gamma 1, 45kDa
  ENSP ID: ENSP00000467626
MSWSFLTRLLEEIHNHSTFVGKIWLTVLIVFRIVLTAVGGESIYYDEQSKFVCNTEQPGCENVCYDAFAPLS

SEQ ID NO: 34146 - protein, 113 aa, Homo sapiens
  Payload ID: 6737
  Gene Symbol: GJC1
  Gene Name: gap junction protein, gamma 1, 45kDa
  ENSP ID: ENSP00000468258
  MOD_RES (1)..(1): Any amino acid
XSAPPGYNIAVKPDQIQYTELSNAKIAYKQNKANTAQEQQYGSHEENLPADLEALQREIRMAQERLDLAVQAYSHQNNPHGPREKKAKVGSKAGSNKSTASSKSGDGKTSVWI

SEQ ID NO: 34147 - protein, 260 aa, Homo sapiens
  Payload ID: 6737
  Gene Symbol: GJC1
  Gene Name: gap junction protein, gamma 1, 45kDa
  ENSP ID: ENSP00000468716
DPMMYPEMELESDKENKEQSQPKPKHDGRRRIREDGLMKIYVLQLLARTVFEVGFLIGQYFLYGFQVHPFYVCSRLPCPHKIDCFISRPTEKTIFLLIMYGVTGLCLLLNIWEMLHLGFGTIRDSLNSKRRELEDPGAYNYPFTWNTPSAPPGYNIAVKPDQIQYTELSNAKIAYKQNKANTAQEQQYGSHEENLPADLEALQREIRMAQERLDLAVQAYSHQNNPHGPREKKAKVGSKAGSNKSTASSKSGDGKTSVWI

SEQ ID NO: 34148 - protein, 439 aa, Homo sapiens
  Payload ID: 6738
  Gene Symbol: GJC2
  Gene Name: gap junction protein, gamma 2, 47kDa
  Uniprot ID: Q5T442
  ENSP ID: ENSP00000355675
MTNMSWSFLTRLLEEIHNHSTFVGKVWLTVLVVFRIVLTAVGGEAIYSDEQAKFTCNTRQPGCDNVCYDAFAPLSHVRFWVFQIVVISTPSVMYLGYAVHRLARASEQERRRALRRRPGPRRAPRAHLPPPHAGWPEPADLGEEEPMLGLGEEEEEEETGAAEGAGEEAEEAGAEEACTKAVGADGKAAGTPGPTGQHDGRRRIQREGLMRVYVAQLVARAAFEVAFLVGQYLLYGFEVRPFFPCSRQPCPHVVDCFVSRPTEKTVFLLVMYVVSCLCLLLNLCEMAHLGLGSAQDAVRGRRGPPASAPAPAPRPPPCAFPAAAAGLACPPDYSLVVRAAERARAHDQNLANLALQALRDGAAAGDRDRDSSPCVGLPAASRGPPRAGAPASRTGSATSAGTVGEQGRPGTHERPGAKPRAGSEKGSASSRDGKTTVWI

SEQ ID NO: 34149 - protein, 279 aa, Homo sapiens
  Payload ID: 6739
  Gene Symbol: GJC3
  Gene Name: gap junction protein, gamma 3, 30.2kDa
  Uniprot ID: Q8NFK1
  ENSP ID: ENSP00000325775
MCGRFLRRLLAEESRRSTPVGRLLLPVLLGFRLVLLAASGPGVYGDEQSEFVCHTQQPGCKAACFDAFHPLSPLRFWVFQVILVAVPSALYMGFTLYHVIWHWELSGKGKEEETLIQGREGNTDVPGAGSLRLLWAYVAQLGARLVLEGAALGLQYHLYGFQMPSSFACRREPCLGSITCNLSRPSEKTIFLKTMFGVSGFCLLFTFLELVLLGLGRWWRTWKHKSSSSKYFLTSESTRRHKKATDSLPVVETKEQFQEAVPGRSLAQEKQRPVGPRDA

SEQ ID NO: 34150 - protein, 217 aa, Homo sapiens
  Payload ID: 6740
  Gene Symbol: GAR1
  Gene Name: GAR1 homolog, ribonucleoprotein
  Uniprot ID: Q9NY12
  ENSP ID: ENSP00000226796
MSFRGGGRGGFNRGGGGGGFNRGGSSNHFRGGGGGGGGGNFRGGGRGGFGRGGGRGGFNKGQDQGPPERVVLLGEFLHPCEDDIVCKCTTDENKVPYFNAPVYLENKEQIGKVDEIFGQLRDFYFSVKLSENMKASSFKKLQKFYIDPYKLLPLQRFLPRPPGEKGPPRGGGRGGRGGGRGGGGRGGGRGGGFRGGRGGGGGGFRGGRGGGFRGRGH

SEQ ID NO: 34151 - protein, 217 aa, Homo sapiens; identical to SEQ ID NO: 34150
  Payload ID: 6740
  Gene Symbol: GAR1
  Gene Name: GAR1 homolog, ribonucleoprotein
  Uniprot ID: Q9NY12
  ENSP ID: ENSP00000378127

SEQ ID NO: 34152 - protein, 445 aa, Homo sapiens
  Payload ID: 6741
  Gene Symbol: GSDMA
  Gene Name: gasdermin A
  Uniprot ID: Q96QA5
  ENSP ID: ENSP00000301659
MTMFENVTRALARQLNPRGDLTPLDSLIDFKRFHPFCLVLRKRKSTLFWGARYVRTDYTLLDVLEPGSSPSDPTDTGNFGFKNMLDTRVEGDVDVPKTVKVKGTAGLSQNSTLEVQTLSVAPKALETVQERKLAADHPFLKEMQDQGENLYVVMEVVETVQEVTLERAGKAEACFSLPFFAPLGLQGSINHKEAVTIPKGCVLAFRVRQLMVKGKDEWDIPHICNDNMQTFPPGEKSGEEKVILIQASDVGDVHEGFRTLKEEVQRETQQVEKLSRVGQSSLLSSLSKLLGKKKELQDLELALEGALDKGHEVTLEALPKDVLLSKEAVGAILYFVGALTELSEAQQKLLVKSMEKKILPVQLKLVESTMEQNFLLDKEGVFPLQPELLSSLGDEELTLTEALVGLSGLEVQRSGPQYMWDPDTLPRLCALYAGLSLLQQLTKAS

SEQ ID NO: 34153 - protein, 158 aa, Homo sapiens
  Payload ID: 6741
  Gene Symbol: GSDMA
  Gene Name: gasdermin A
  ENSP ID: ENSP00000461985
MTMFENVTRALARQLNPRGDLTPLDSLIDFKRFHPFCLVLRKRKSTLFWGARYVRTDYTLLDVLEPGSSPSDPTDTGNFGFKNMLDTRVEGDVDVPKTVKVKGTAGLSQNSTLEVQTLSVAPKALETVQERKLAADHPFLKEMQDQGENLYVVMEVVE

SEQ ID NO: 34154 - protein, 403 aa, Homo sapiens
  Payload ID: 6742
  Gene Symbol: GSDMB
  Gene Name: gasdermin B
  Uniprot ID: Q8TAX9
  ENSP ID: ENSP00000312584
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMKKDGASSCLGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 34155 - protein, 416 aa, Homo sapiens
  Payload ID: 6742
  Gene Symbol: GSDMB
  Gene Name: gasdermin B
  Uniprot ID: Q8TAX9
  ENSP ID: ENSP00000353465
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMNIHFRGKTKSFPEEKDGASSCLGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 34156 - protein, 394 aa, Homo sapiens
  Payload ID: 6742
  Gene Symbol: GSDMB
  Gene Name: gasdermin B
  Uniprot ID: Q8TAX9
  ENSP ID: ENSP00000377729
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMRKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 34157 - protein, 403 aa, Homo sapiens; identical to SEQ ID NO: 34154
  Payload ID: 6742
  Gene Symbol: GSDMB
  Gene Name: gasdermin B
  Uniprot ID: Q8TAX9
  ENSP ID: ENSP00000377733

SEQ ID NO: 34158 - protein, 416 aa, Homo sapiens; identical to SEQ ID NO: 34155
  Payload ID: 6742
  Gene Symbol: GSDMB
  Gene Name: gasdermin B
  Uniprot ID: Q8TAX9
  ENSP ID: ENSP00000415049

SEQ ID NO: 34159 - protein, 183 aa, Homo sapiens
  Payload ID: 6742
  Gene Symbol: GSDMB
  Gene Name: gasdermin B
  ENSP ID: ENSP00000428217
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENREGWCFILFRKVFGFGGFQKHEGEVGGHGECPQGPDRGEEKRCAKLPR

SEQ ID NO: 34160 - protein, 203 aa, Homo sapiens
  Payload ID: 6742
  Gene Symbol: GSDMB
  Gene Name: gasdermin B
  ENSP ID: ENSP00000428712
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKESLWVRRIPET

SEQ ID NO: 34161 - protein, 200 aa, Homo sapiens
  Payload ID: 6742
  Gene Symbol: GSDMB
  Gene Name: gasdermin B
  ENSP ID: ENSP00000429265
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKRRMVLHPV

SEQ ID NO: 34162 - protein, 407 aa, Homo sapiens
  Payload ID: 6742
  Gene Symbol: GSDMB
  Gene Name: gasdermin B
  Uniprot ID: Q8TAX9
  ENSP ID: ENSP00000430157
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMNIHFRGKTKSFPEGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 34163 - protein, 74 aa, Homo sapiens
  Payload ID: 6742
  Gene Symbol: GSDMB
  Gene Name: gasdermin B
  ENSP ID: ENSP00000463519
  MOD_RES (1)..(1): Any amino acid
XATLENRKLKRELPFSFRSINTRENLYLVTETLETVKEETLKSDRQYKFWSQISQGHLSYKHKESLWVRRIPET

SEQ ID NO: 34164 - protein, 508 aa, Homo sapiens
  Payload ID: 6743
  Gene Symbol: GSDMC
  Gene Name: gasdermin C
  Uniprot ID: Q9BYG8
  ENSP ID: ENSP00000276708
MPSMLERISKNLVKEIGSKDLTPVKYLLSATKLRQFVILRKKKDSRSSFWEQSDYVPVEFSLNDILEPSSSVLETVVTGPFHFSDIMIQKHKADMGVNVGIEVSVSGEASVDHGCSLEFQIVTIPSPNLEDFQKRKLLDPEPSFLKECRRRGDNLYVVTEAVELINNTVLYDSSSVNILGKIALWITYGKGQGQGESLRVKKKALTLQKGMVMAYKRKQLVIKEKAILISDDDEQRTFQDEYEISEMVGYCAARSEGLLPSFHTISPTLFNASSNDMKLKPELFLTQQFLSGHLPKYEQVHILPVGRIEEPFWQNFKHLQEEVFQKIKTLAQLSKDVQDVMFYSILAMLRDRGALQDLMNMLELDSSGHLDGPGGAILKKLQQDSNHAWFNPKDPILYLLEAIMVLSDFQHDLLACSMEKRILLQQQELVRSILEPNFRYPWSIPFTLKPELLAPLQSEGLAITYGLLEECGLRMELDNPRSTWDVEAKMPLSALYGTLSLLQQLAEA

SEQ ID NO: 34165 - protein, 508 aa, Homo sapiens; identical to SEQ ID NO: 34164
  Payload ID: 6743
  Gene Symbol: GSDMC
  Gene Name: gasdermin C
  Uniprot ID: Q9BYG8
  ENSP ID: ENSP00000482343

SEQ ID NO: 34166 - protein, 484 aa, Homo sapiens
  Payload ID: 6744
  Gene Symbol: GSDMD
  Gene Name: gasdermin D
  Uniprot ID: P57764
  ENSP ID: ENSP00000262580
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPSGLSMMRCLHNFLTDGVPAEGAFTEDFQGLRAEVETISKELELLDRELCQLLLEGLEGVLRDQLALRALEEALEQGQSLGPVEPLDGPAGAVLECLVLSSGMLVPELAIPVVYLLGALTMLSETQHKLLAEALESQTLLGPLELVGSLLEQSAPWQERSTMSLPPGLLGNSWGEGAPAWVLLDECGLELGEDTPHVCWEPQAQGRMCALYASLALLSGLSQEPH

SEQ ID NO: 34167 - protein, 48 aa, Homo sapiens
  Payload ID: 6744
  Gene Symbol: GSDMD
  Gene Name: gasdermin D
  ENSP ID: ENSP00000432351
MGSAFERVVRRVVQELDHGGEFIPVTSLQSSTGFQPYCLVVRKPSSSW

SEQ ID NO: 34168 - protein, 484 aa, Homo sapiens; identical to SEQ ID NO: 34166
  Payload ID: 6744
  Gene Symbol: GSDMD
  Gene Name: gasdermin D
  Uniprot ID: P57764
  ENSP ID: ENSP00000433209

SEQ ID NO: 34169 - protein, 231 aa, Homo sapiens
  Payload ID: 6744
  Gene Symbol: GSDMD
  Gene Name: gasdermin D
  ENSP ID: ENSP00000433263
  MOD_RES (1)..(1): Any amino acid
XRELCQLLLEGLEGVLRDQLALRALEEALEQGQSLGPVEPLDGPAGAVLECLVLSSGMLVPELAIPVVYLLGALTMLSETQHKLLAEALESQTLLGPLELPLGAECPVAGAQHHVPAPRAPGEQLGRRSTGLGLAGRVWPRAGGGHSPRVLGAAGPGPHVCTLRLPGTAIRTEPGAPLACARAWPGSSPAGQSVCPPAASPRKARSPVAMWPVYHGAQELGKHNKGGIRRK

SEQ ID NO: 34170 - protein, 532 aa, Homo sapiens
  Payload ID: 6744
  Gene Symbol: GSDMD
  Gene Name: gasdermin D
  ENSP ID: ENSP00000433958
MISAHCNLHLPGSSDSLASASQLLLAGRLPGRADAPDAPPSGRRRSRSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPSGLSMMRCLHNFLTDGVPAEGAFTEDFQGLRAEVETISKELELLDRELCQLLLEGLEGVLRDQLALRALEEALEQGQSLGPVEPLDGPAGAVLECLVLSSGMLVPELAIPVVYLLGALTMLSETQHKLLAEALESQTLLGPLELVGSLLEQSAPWQERSTMSLPPGLLGNSWGEGAPAWVLLDECGLELGEDTPHVCWEPQAQGRMCALYASLALLSGLSQEPH

SEQ ID NO: 34171 - protein, 164 aa, Homo sapiens
  Payload ID: 6744
  Gene Symbol: GSDMD
  Gene Name: gasdermin D
  ENSP ID: ENSP00000434386
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVL

SEQ ID NO: 34172 - protein, 114 aa, Homo sapiens
  Payload ID: 6744
  Gene Symbol: GSDMD
  Gene Name: gasdermin D
  ENSP ID: ENSP00000434452
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSS

SEQ ID NO: 34173 - protein, 277 aa, Homo sapiens
  Payload ID: 6744
  Gene Symbol: GSDMD
  Gene Name: gasdermin D
  ENSP ID: ENSP00000436684
MELQAQRRPWRTQLGSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPS

SEQ ID NO: 34174 - protein, 153 aa, Homo sapiens
  Payload ID: 6744
  Gene Symbol: GSDMD
  Gene Name: gasdermin D
  ENSP ID: ENSP00000437065
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSR

SEQ ID NO: 34175 - protein, 484 aa, Homo sapiens; identical to SEQ ID NO: 34166
  Payload ID: 6744
  Gene Symbol: GSDMD
  Gene Name: gasdermin D
  Uniprot ID: P57764
  ENSP ID: ENSP00000482096

SEQ ID NO: 34176 - protein, 532 aa, Homo sapiens; identical to SEQ ID NO: 34170
  Payload ID: 6744
  Gene Symbol: GSDMD
  Gene Name: gasdermin D
  ENSP ID: ENSP00000486410

SEQ ID NO: 34177 - protein, 231 aa, Homo sapiens; identical to SEQ ID NO: 34169
  Payload ID: 6744
  Gene Symbol: GSDMD
  Gene Name: gasdermin D
  ENSP ID: ENSP00000487774
  MOD_RES (1)..(1): Any amino acid

SEQ ID NO: 34178 - protein, 164 aa, Homo sapiens; identical to SEQ ID NO: 34171
  Payload ID: 6744
  Gene Symbol: GSDMD
  Gene Name: gasdermin D
  ENSP ID: ENSP00000487934

SEQ ID NO: 34179 - protein, 484 aa, Homo sapiens; identical to SEQ ID NO: 34166
  Payload ID: 6744
  Gene Symbol: GSDMD
  Gene Name: gasdermin D
  Uniprot ID: P57764
  ENSP ID: ENSP00000488012

SEQ ID NO: 34180 - protein, 277 aa, Homo sapiens; identical to SEQ ID NO: 34173
  Payload ID: 6744
  Gene Symbol: GSDMD
  Gene Name: gasdermin D
  ENSP ID: ENSP00000488049

SEQ ID NO: 34181 - protein, 114 aa, Homo sapiens; identical to SEQ ID NO: 34172
  Payload ID: 6744
  Gene Symbol: GSDMD
  Gene Name: gasdermin D
  ENSP ID: ENSP00000488317

SEQ ID NO: 34182 - protein, 153 aa, Homo sapiens; identical to SEQ ID NO: 34174
  Payload ID: 6744
  Gene Symbol: GSDMD
  Gene Name: gasdermin D
  ENSP ID: ENSP00000488419

SEQ ID NO: 34183 - protein, 48 aa, Homo sapiens; identical to SEQ ID NO: 34167
  Payload ID: 6744
  Gene Symbol: GSDMD
  Gene Name: gasdermin D
  ENSP ID: ENSP00000488563

SEQ ID NO: 34184 - protein, 153 aa, Homo sapiens
  Payload ID: 6745
  Gene Symbol: GIP
  Gene Name: gastric inhibitory polypeptide
  Uniprot ID: P09681
  ENSP ID: ENSP00000350005
MVATKTFALLLLSLFLAVGLGEKKEGHFSALPSLPVGSHAKVSSPQPRGPRYAEGTFISDYSIAMDKIHQQDFVNWLLAQKGKKNDWKHNITQREARALELASQANRKEEEAVEPQSSPAKNPSDEDLLRDLLIQELLACLLDQTNLCRLRSR

SEQ ID NO: 34185 - protein, 419 aa, Homo sapiens
  Payload ID: 6746
  Gene Symbol: GIPR
  Gene Name: gastric inhibitory polypeptide receptor
  Uniprot ID: P48546
  ENSP ID: ENSP00000263281
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVGRDPAAAPALWRQRGVRRRL

SEQ ID NO: 34186 - protein, 430 aa, Homo sapiens
  Payload ID: 6746
  Gene Symbol: GIPR
  Gene Name: gastric inhibitory polypeptide receptor
  Uniprot ID: P48546
  ENSP ID: ENSP00000305321
MTTSPILQLLLRLSLCGLLLQRAETGSKGQTAGELYQRWERYRRECQETLAAAEPPSVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 34187 - protein, 17 aa, Homo sapiens
  Payload ID: 6746
  Gene Symbol: GIPR
  Gene Name: gastric inhibitory polypeptide receptor
  ENSP ID: ENSP00000465385
MYVCWDYAAPNATARAS

SEQ ID NO: 34188 - protein, 265 aa, Homo sapiens
  Payload ID: 6746
  Gene Symbol: GIPR
  Gene Name: gastric inhibitory polypeptide receptor
  ENSP ID: ENSP00000467342
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWD

SEQ ID NO: 34189 - protein, 466 aa, Homo sapiens
  Payload ID: 6746
  Gene Symbol: GIPR
  Gene Name: gastric inhibitory polypeptide receptor
  Uniprot ID: P48546
  ENSP ID: ENSP00000467494
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 34190 - protein, 417 aa, Homo sapiens
  Payload ID: 6747
  Gene Symbol: GIF
  Gene Name: gastric intrinsic factor (vitamin B synthesis)
  Uniprot ID: P27352
  ENSP ID: ENSP00000257248
MAWFALYLLSLLWATAGTSTQTQSSCSVPSAQEPLVNGIQVLMENSVTSSAYPNPSILIAMNLAGAYNLKAQKLLTYQLMSSDNNDLTIGQLGLTIMALTSSCRDPGDKVSILQRQMENWAPSSPNAEASAFYGPSLAILALCQKNSEATLPIAVRFAKTLLANSSPFNVDTGAMATLALTCMYNKIPVGSEEGYRSLFGQVLKDIVEKISMKIKDNGIIGDIYSTGLAMQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGVADYIPFNHEHITANFTQY

SEQ ID NO: 34191 - protein, 48 aa, Homo sapiens
  Payload ID: 6747
  Gene Symbol: GIF
  Gene Name: gastric intrinsic factor (vitamin B synthesis)
  ENSP ID: ENSP00000433196
MAWFALYLLSLLWATAGTSTQTQSSCCEYDVFPRRSGKQLPWGRGCDL

SEQ ID NO: 34192 - protein, 101 aa, Homo sapiens
  Payload ID: 6748
  Gene Symbol: GAST
  Gene Name: gastrin
  Uniprot ID: P01350
  ENSP ID: ENSP00000331358
MQRLCVYVLIFALALAAFSEASWKPRSQQPDAPLGTGANRDLELPWLEQQGPASHHRRQLGPQGPPHLVADPSKKQGPWLEEEEEAYGWMDFGRRSAEDEN

SEQ ID NO: 34193 - protein, 148 aa, Homo sapiens
  Payload ID: 6749
  Gene Symbol: GRP
  Gene Name: gastrin-releasing peptide
  Uniprot ID: P07492
  ENSP ID: ENSP00000256857
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 34194 - protein, 141 aa, Homo sapiens
  Payload ID: 6749
  Gene Symbol: GRP
  Gene Name: gastrin-releasing peptide
  Uniprot ID: P07492
  ENSP ID: ENSP00000389696
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKGSQREGRNPQLNQQ

SEQ ID NO: 34195 - protein, 96 aa, Homo sapiens
  Payload ID: 6749
  Gene Symbol: GRP
  Gene Name: gastrin-releasing peptide
  ENSP ID: ENSP00000397814
  MOD_RES (1)..(1): Any amino acid
XHLMGKKSTGESSSVSERGSLKQQLREYIRWEEAARNLLGLIEAKENRNHQPPQPKALGNQQPSWDSEDSSNFKDVGSKGKDSLLQVLNVKEGTPS

SEQ ID NO: 34196 - protein, 35 aa, Homo sapiens
  Payload ID: 6749
  Gene Symbol: GRP
  Gene Name: gastrin-releasing peptide
  ENSP ID: ENSP00000431579
  MOD_RES (1)..(1): Any amino acid
XISSLRGIQRIAATSKILSAPGSQREGRNPQLNQQ

SEQ ID NO: 34197 - protein, 138 aa, Homo sapiens
  Payload ID: 6749
  Gene Symbol: GRP
  Gene Name: gastrin-releasing peptide
  Uniprot ID: P07492
  ENSP ID: ENSP00000434101
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDLVDSLLQVLNVKEGTPS

SEQ ID NO: 34198 - protein, 384 aa, Homo sapiens
  Payload ID: 6750
  Gene Symbol: GRPR
  Gene Name: gastrin-releasing peptide receptor
  Uniprot ID: P30550
  ENSP ID: ENSP00000369643
MALNDCFLLNLEVDHFMHCNISSHSADLPVNDDWSHPGILYVIPAVYGVIILIGLIGNITLIKIFCTVKSMRNVPNLFISSLALGDLLLLITCAPVDASRYLADRWLFGRIGCKLIPFIQLTSVGVSVFTLTALSADRYKAIVRPMDIQASHALMKICLKAAFIWIISMLLAIPEAVFSDLHPFHEESTNQTFISCAPYPHSNELHPKIHSMASFLVFYVIPLSIISVYYYFIAKNLIQSAYNLPVEGNIHVKKQIESRKRLAKTVLVFVGLFAFCWLPNHVIYLYRSYHYSEVDTSMLHFVTSICARLLAFTNSCVNPFALYLLSKSFRKQFNTQLLCCQPGLIIRSHSTGRSTTCMTSLKSTNPSVATFSLINGNICHERYV

SEQ ID NO: 34199 - protein, 199 aa, Homo sapiens
  Payload ID: 6751
  Gene Symbol: GKN1
  Gene Name: gastrokine 1
  Uniprot ID: Q9NS71
  ENSP ID: ENSP00000367172
MLAYSSVHCFREDKMKFTIVFAGLLGVFLAPALANYNINVNDDNNNAGSGQQSVSVNNEHNVANVDNNNGWDSWNSIWDYGNGFAATRLFQKKTCIVHKMNKEVMPSIQSLDALVKEKKLQGKGPGGPPPKGLMYSVNPNKVDDLSKFGKNIANMCRGIPTYMAEEMQEASLFFYSGTCYTTSVLWIVDISFCGDTVEN

SEQ ID NO: 34200 - protein, 184 aa, Homo sapiens
  Payload ID: 6752
  Gene Symbol: GKN2
  Gene Name: gastrokine 2
  Uniprot ID: Q86XP6
  ENSP ID: ENSP00000329292
MKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTHNVGAGGCAKAGLLGILGISICADIHV

SEQ ID NO: 34201 - protein, 161 aa, Homo sapiens
  Payload ID: 6752
  Gene Symbol: GKN2
  Gene Name: gastrokine 2
  ENSP ID: ENSP00000428538
MKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTREYQ

SEQ ID NO: 34202 - protein, 363 aa, Homo sapiens
  Payload ID: 6753
  Gene Symbol: GBX1
  Gene Name: gastrulation brain homeobox 1
  Uniprot ID: Q14549
  ENSP ID: ENSP00000297537
MQRAGGGSAPGGNGGGGGGGPGTAFSIDSLIGPPPPRSGHLLYTGYPMFMPYRPLVLPQALAPAPLPAGLPPLAPLASFAGRLTNTFCAGLGQAVPSMVALTTALPSFAEPPDAFYGPQELAAAAAAAAATAARNNPEPGGRRPEGGLEADELLPAREKVAEPPPPPPPHFSETFPSLPAEGKVYSSDEEKLEASAGDPAGSEQEEEGSGGDSEDDGFLDSSAGGPGALLGPKPKLKGSLGTGAEEGAPVTAGVTAPGGKSRRRRTAFTSEQLLELEKEFHCKKYLSLTERSQIAHALKLSEVQVKIWFQNRRAKWKRIKAGNVSSRSGEPVRNPKIVVPIPVHVNRFAVRSQHQQMEQGARP

SEQ ID NO: 34203 - protein, 348 aa, Homo sapiens
  Payload ID: 6754
  Gene Symbol: GBX2
  Gene Name: gastrulation brain homeobox 2
  Uniprot ID: P52951
  ENSP ID: ENSP00000302251
MSAAFPPSLMMMQRPLGSSTAFSIDSLIGSPPQPSPGHFVYTGYPMFMPYRPVVLPPPPPPPPALPQAALQPALPPAHPHHQIPSLPTGFCSSLAQGMALTSTLMATLPGGFSASPQHQEAAAARKFAPQPLPGGGNFDKAEALQADAEDGKGFLAKEGSLLAFSAAETVQASLVGAVRGQGKDESKVEDDPKGKEESFSLESDVDYSSDDNLTGQAAHKEEDPGHALEETPPSSGAAGSTTSTGKNRRRRTAFTSEQLLELEKEFHCKKYLSLTERSQIAHALKLSEVQVKIWFQNRRAKWKRVKAGNANSKTGEPSRNPKIVVPIPVHVSRFAIRSQHQQLEQARP

SEQ ID NO: 34204 - protein, 222 aa, Homo sapiens
  Payload ID: 6754
  Gene Symbol: GBX2
  Gene Name: gastrulation brain homeobox 2
  ENSP ID: ENSP00000448747
MSAAFPPSLMMMQRPLGSSTAFSIDSLIGSPPQPSPGHFVYTGYPMFMPYRPVVLPPPPPPPPALPQAALQPALPPAHPHHQIPSLPTGFCSSLAQGMALTSTLMATLPGGFSASPQHQEAAAARKFAPQPLPGGGNFDKAEALQADAEDGKGFLAKEGSLLAFSAAETVQASLGRLCRSAVTWGSGRGCPRARERRVKGGRRPEGQGGELLAGERCGLQLG

SEQ ID NO: 34205 - protein, 334 aa, Homo sapiens
  Payload ID: 6755
  Gene Symbol: GATA1
  Gene Name: GATA binding protein 1 (globin transcription factor 1)
  ENSP ID: ENSP00000365853
MEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQHYCGGSAQLMRAQSMASRGGVVSFSSCSQNSGQPKSLGPRHPLA

SEQ ID NO: 34206 - protein, 413 aa, Homo sapiens
  Payload ID: 6755
  Gene Symbol: GATA1
  Gene Name: GATA binding protein 1 (globin transcription factor 1)
  Uniprot ID: P15976
  ENSP ID: ENSP00000365858
MEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQVNRPLTMRKDGIQTRNRKASGKGKKKRGSSLGGTGAAEGPAGGFMVVAGGSGSGNCGEVASGLTLGPPGTAHLYQGLGPVVLSGPVSHLMPFPGPLLGSPTGSFPTGPMPPTTSTTVVAPLSS

SEQ ID NO: 34207 - protein, 480 aa, Homo sapiens
  Payload ID: 6756
  Gene Symbol: GATA2
  Gene Name: GATA binding protein 2
  Uniprot ID: P23769
  ENSP ID: ENSP00000345681
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 34208 - protein, 466 aa, Homo sapiens
  Payload ID: 6756
  Gene Symbol: GATA2
  Gene Name: GATA binding protein 2
  Uniprot ID: P23769
  ENSP ID: ENSP00000400259
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 34209 - protein, 480 aa, Homo sapiens; identical to SEQ ID NO: 34207
  Payload ID: 6756
  Gene Symbol: GATA2
  Gene Name: GATA binding protein 2
  Uniprot ID: P23769
  ENSP ID: ENSP00000417074

SEQ ID NO: 34210 - protein, 150 aa, Homo sapiens
  Payload ID: 6756
  Gene Symbol: GATA2
  Gene Name: GATA binding protein 2
  ENSP ID: ENSP00000418132
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGG

SEQ ID NO: 34211 - protein, 8 aa, Homo sapiens
  Payload ID: 6756
  Gene Symbol: GATA2
  Gene Name: GATA binding protein 2
  ENSP ID: ENSP00000419532
MEVAPEQP

SEQ ID NO: 34212 - protein, 443 aa, Homo sapiens
  Payload ID: 6757
  Gene Symbol: GATA3
  Gene Name: GATA binding protein 3
  Uniprot ID: P23771
  ENSP ID: ENSP00000341619
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 34213 - protein, 444 aa, Homo sapiens
  Payload ID: 6757
  Gene Symbol: GATA3
  Gene Name: GATA binding protein 3
  Uniprot ID: P23771
  ENSP ID: ENSP00000368632
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTEGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 34214 - protein, 442 aa, Homo sapiens
  Payload ID: 6758
  Gene Symbol: GATA4
  Gene Name: GATA binding protein 4
  Uniprot ID: P43694
  ENSP ID: ENSP00000334458
MYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 34215 - protein, 116 aa, Homo sapiens
  Payload ID: 6758
  Gene Symbol: GATA4
  Gene Name: GATA binding protein 4
  ENSP ID: ENSP00000432278
MYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGS

SEQ ID NO: 34216 - protein, 236 aa, Homo sapiens
  Payload ID: 6758
  Gene Symbol: GATA4
  Gene Name: GATA binding protein 4
  ENSP ID: ENSP00000435043
MFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 34217 - protein, 175 aa, Homo sapiens
  Payload ID: 6758
  Gene Symbol: GATA4
  Gene Name: GATA binding protein 4
  ENSP ID: ENSP00000435347
MFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVS

SEQ ID NO: 34218 - protein, 443 aa, Homo sapiens
  Payload ID: 6758
  Gene Symbol: GATA4
  Gene Name: GATA binding protein 4
  Uniprot ID: P43694
  ENSP ID: ENSP00000435712
MYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLVDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 34219 - protein, 23 aa, Homo sapiens
  Payload ID: 6758
  Gene Symbol: GATA4
  Gene Name: GATA binding protein 4
  ENSP ID: ENSP00000473598
MYQSLAMAANHGPPPGAYEAGGP

SEQ ID NO: 34220 - protein, 16 aa, Homo sapiens
  Payload ID: 6758
  Gene Symbol: GATA4
  Gene Name: GATA binding protein 4
  ENSP ID: ENSP00000473671
MYQSLAMAANHGPPPG

SEQ ID NO: 34221 - protein, 441 aa, Homo sapiens
  Payload ID: 6758
  Gene Symbol: GATA4
  Gene Name: GATA binding protein 4
  ENSP ID: ENSP00000482268
MYQSLPWPPTTGRPPVPTRRAAPAPSCTARAPRPRQSTCPHRGALLRAGPVLPPGRRRGLCVRRASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 34222 - protein, 397 aa, Homo sapiens
  Payload ID: 6759
  Gene Symbol: GATA5
  Gene Name: GATA binding protein 5
  Uniprot ID: Q9BWX5
  ENSP ID: ENSP00000252997
MYQSLALAASPRQAAYADSGSFLHAPGAGSPMFVPPARVPSMLSYLSGCEPSPQPPELAARPGWAQTATADSSAFGPGSPHPPAAHPPGATAFPFAHSPSGPGSGGSAGGRDGSAYQGALLPREQFAAPLGRPVGTSYSATYPAYVSPDVAQSWTAGPFDGSVLHGLPGRRPTFVSDFLEEFPGEGRECVNCGALSTPLWRRDGTGHYLCNACGLYHKMNGVNRPLVRPQKRLSSSRRAGLCCTNCHTTNTTLWRRNSEGEPVCNACGLYMKLHGVPRPLAMKKESIQTRKRKPKTIAKARGSSGSTRNASASPSAVASTDSSAATSKAKPSLASPVCPGPSMAPQASGQEDDSLAPGHLEFKFEPEDFAFPSTAPSPQAGLRGALRQEAWCALALA

SEQ ID NO: 34223 - protein, 595 aa, Homo sapiens
  Payload ID: 6760
  Gene Symbol: GATA6
  Gene Name: GATA binding protein 6
  Uniprot ID: Q92908
  ENSP ID: ENSP00000269216
MALTDGGWCLPKRFGAAGADASDSRAFPAREPSTPPSPISSSSSSCSRGGERGPGGASNCGTPQLDTEAAAGPPARSLLLSSYASHPFGAPHGPSAPGVAGPGGNLSSWEDLLLFTDLDQAATASKLLWSSRGAKLSPFAPEQPEEMYQTLAALSSQGPAAYDGAPGGFVHSAAAAAAAAAAASSPVYVPTTRVGSMLPGLPYHLQGSGSGPANHAGGAGAHPGWPQASADSPPYGSGGGAAGGGAAGPGGAGSAAAHVSARFPYSPSPPMANGAAREPGGYAAAGSGGAGGVSGGGSSLAAMGGREPQYSSLSAARPLNGTYHHHHHHHHHHPSPYSPYVGAPLTPAWPAGPFETPVLHSLQSRAGAPLPVPRGPSADLLEDLSESRECVNCGSIQTPLWRRDGTGHYLCNACGLYSKMNGLSRPLIKPQKRVPSSRRLGLSCANCHTTTTTLWRRNAEGEPVCNACGLYMKLHGVPRPLAMKKEGIQTRKRKPKNINKSKTCSGNSNNSIPMTPTSTSSNSDDCSKNTSPTTQPTASGAGAPVMTGAGESTNPENSELKYSGQDGLYIGVSLASPAEVTSSVRPDSWCALALA

SEQ ID NO: 34224 - protein, 595 aa, Homo sapiens; identical to SEQ ID NO: 34223
  Payload ID: 6760
  Gene Symbol: GATA6
  Gene Name: GATA binding protein 6
  Uniprot ID: Q92908
  ENSP ID: ENSP00000462313

SEQ ID NO: 34225 - protein, 269 aa, Homo sapiens
  Payload ID: 6761
  Gene Symbol: GATAD1
  Gene Name: GATA zinc finger domain containing 1
  Uniprot ID: Q8WUU5
  ENSP ID: ENSP00000287957
MPLGLKPTCSVCKTTSSSMWKKGAQGEILCHHCTGRGGAGSGGAGSGAAGGTGGSGGGGFGAATFASTSATPPQSNGGGGGKQSKQEIHRRSARLRNTKYKSAPAAEKKVSTKGKGRRHIFKLKNPIKAPESVSTIITAESIFYKGVYYQIGDVVSVIDEQDGKPYYAQIRGFIQDQYCEKSAALTWLIPTLSSPRDQFDPASYIIGPEEDLPRKMEYLEFVCHAPSEYFKSRSSPFPTVPTRPEKGYIWTHVGPTPAITIKESVANHL

SEQ ID NO: 34226 - protein, 633 aa, Homo sapiens
  Payload ID: 6762
  Gene Symbol: GATAD2A
  Gene Name: GATA zinc finger domain containing 2A
  Uniprot ID: Q86YP4
  ENSP ID: ENSP00000351552
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQVIKPRRKLAFRSGEARDWSNGAVLQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 34227 - protein, 633 aa, Homo sapiens; identical to SEQ ID NO: 34226
  Payload ID: 6762
  Gene Symbol: GATAD2A
  Gene Name: GATA zinc finger domain containing 2A
  Uniprot ID: Q86YP4
  ENSP ID: ENSP00000353463

SEQ ID NO: 34228 - protein, 634 aa, Homo sapiens
  Payload ID: 6762
  Gene Symbol: GATAD2A
  Gene Name: GATA zinc finger domain containing 2A
  Uniprot ID: Q86YP4
  ENSP ID: ENSP00000384899
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQAGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQVIKPRRKLAFRSGEARDWSNGAVLQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 34229 - protein, 139 aa, Homo sapiens
  Payload ID: 6762
  Gene Symbol: GATAD2A
  Gene Name: GATA zinc finger domain containing 2A
  ENSP ID: ENSP00000390495
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPE

SEQ ID NO: 34230 - protein, 177 aa, Homo sapiens
  Payload ID: 6762
  Gene Symbol: GATAD2A
  Gene Name: GATA zinc finger domain containing 2A
  ENSP ID: ENSP00000403703
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQ

SEQ ID NO: 34231 - protein, 165 aa, Homo sapiens
  Payload ID: 6762
  Gene Symbol: GATAD2A
  Gene Name: GATA zinc finger domain containing 2A
  ENSP ID: ENSP00000404212
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKL

SEQ ID NO: 34232 - protein, 93 aa, Homo sapiens
  Payload ID: 6762
  Gene Symbol: GATAD2A
  Gene Name: GATA zinc finger domain containing 2A
  ENSP ID: ENSP00000407293
MTEEACRTRSQKRALERDPTEDDVESKKIKMERGLLASDLNTDGDMRVTPEPGAGPTQGLLRATEATAMAMGRGEGLVGDGPVDMRTSHSDMK

SEQ ID NO: 34233 - protein, 99 aa, Homo sapiens
  Payload ID: 6762
  Gene Symbol: GATAD2A
  Gene Name: GATA zinc finger domain containing 2A
  ENSP ID: ENSP00000411869
MTEEACRTRSQKRALERDPTEDDVESKKIKMERGLLASDLNTDGDMRVTPEPGAGPTQGLLRATEATAMAMGRGEGLVGDGPVDMRTSHRKAVLKNEKG

SEQ ID NO: 34234 - protein, 126 aa, Homo sapiens
  Payload ID: 6762
  Gene Symbol: GATAD2A
  Gene Name: GATA zinc finger domain containing 2A
  ENSP ID: ENSP00000414252
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALK

SEQ ID NO: 34235 - protein, 95 aa, Homo sapiens
  Payload ID: 6762
  Gene Symbol: GATAD2A
  Gene Name: GATA zinc finger domain containing 2A
  ENSP ID: ENSP00000476500
MTEEACRTRSQKRALERDPTEDDVESKKIKMERGLLASDLNTDGDMRVTPEPGAGPTQGLLRATEATAMAMGRGEGLVGDGPVDMRTSHSPPQHH

SEQ ID NO: 34236 - protein, 77 aa, Homo sapiens
  Payload ID: 6762
  Gene Symbol: GATAD2A
  Gene Name: GATA zinc finger domain containing 2A
  ENSP ID: ENSP00000477171
MTEEACRTRSQKRALERDPTEDDVESKKIKMERGLLASDLNTDGDMRVTPEPGAGPTQGLLRATEATAMAMGRGEGL

SEQ ID NO: 34237 - protein, 593 aa, Homo sapiens
  Payload ID: 6763
  Gene Symbol: GATAD2B
  Gene Name: GATA zinc finger domain containing 2B
  Uniprot ID: Q8WXI9
  ENSP ID: ENSP00000357644
MDRMTEDALRLNLLKRSLDPADERDDVLAKRLKMEGHEAMERLKMLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLVRTTTPNMNPAINYQPQSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQAPQPQSSLQRGIPTSARSMLSNFAQAPQLSVPGGLLGMPGVNIAYLNTGIGGHKGPSLADRQREYLLDMIPPRSISQSISGQK

SEQ ID NO: 34238 - protein, 593 aa, Homo sapiens; identical to SEQ ID NO: 34237
  Payload ID: 6763
  Gene Symbol: GATAD2B
  Gene Name: GATA zinc finger domain containing 2B
  Uniprot ID: Q8WXI9
  ENSP ID: ENSP00000458280

SEQ ID NO: 34239 - protein, 593 aa, Homo sapiens; identical to SEQ ID NO: 34237
  Payload ID: 6763
  Gene Symbol: GATAD2B
  Gene Name: GATA zinc finger domain containing 2B
  ENSP ID: ENSP00000489184

SEQ ID NO: 34240 - protein, 263 aa, Homo sapiens
  Payload ID: 6763
  Gene Symbol: GATAD2B
  Gene Name: GATA zinc finger domain containing 2B
  ENSP ID: ENSP00000489309
  MOD_RES (1)..(1): Any amino acid
XRSATNTTLPHMLMSQRVIAPNPAQLQGQRGPPKPGLVRTTTPNMNPAINYQPSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQA

SEQ ID NO: 34241 - protein, 187 aa, Homo sapiens
  Payload ID: 6763
  Gene Symbol: GATAD2B
  Gene Name: GATA zinc finger domain containing 2B
  ENSP ID: ENSP00000489313
MDRMTEDALRLNLLKRSLDPADERDDVLAKRLKMEGHEAMERLKMLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLR

SEQ ID NO: 34242 - protein, 149 aa, Homo sapiens
  Payload ID: 6763
  Gene Symbol: GATAD2B
  Gene Name: GATA zinc finger domain containing 2B
  ENSP ID: ENSP00000489566
MDRMTEDALRLNLLKRSLDPADERDDVLAKRLKMEGHEAMERLKMLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAA

SEQ ID NO: 34243 - protein, 577 aa, Homo sapiens
  Payload ID: 6763
  Gene Symbol: GATAD2B
  Gene Name: GATA zinc finger domain containing 2B
  ENSP ID: ENSP00000489595
MDRMTEDALRLNLLKRSLDPADERDDVLAKRLKMEGHEAMERLKMLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLQSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQAPQPQSSLQRGIPTSARSMLSNFAQAPQLSVPGGLLGMPGVNIAYLNTGIGGHKGPSLADRQREYLLDMIPPRSISQSISGQK

SEQ ID NO: 34244 - protein, 329 aa, Homo sapiens
  Payload ID: 6764
  Gene Symbol: GATSL2
  Gene Name: GATS protein-like 2
  Uniprot ID: A6NHX0
  ENSP ID: ENSP00000484732
MELHILEHRLQVASVAKESIPLFTYGLIKLAFLSSKTRCKFFSLTETPEDYTIIVDEEGFLELPSSEHLSVADATWLALNVVSGGGSFSSSQPIGVTKIAKSVIAPLADQNISVFMLSTYQTDFILVRERDLPFVTHTLSSEFTILRVVNGETVAAENLGITNGFVKPKLVQRPVIHPLSSPSNRFCVTSLDPDTLPAVATLLMDVMFYSNGVKDPMATGDDCGHIRFFSFSLIEGYISLVMDVQTQQRFPSNLLFTSASGELWKMVRIGGQPLGFDECGIVAQISEPLAAADIPAYYISTFKFDHALVPEENINGVISALKVSQAEKH

SEQ ID NO: 34245 - protein, 329 aa, Homo sapiens
  Payload ID: 6765
  Gene Symbol: GATSL3
  Gene Name: GATS protein-like 3
  Uniprot ID: Q8WTX7
  ENSP ID: ENSP00000384183
MELHILEHRVRVLSVARPGLWLYTHPLIKLLFLPRRSRCKFFSLTETPEDYTLMVDEEGFKELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHSTPKEAASSSPEPSSITFFAFSLIEGYISIVMDAETQKKFPSDLLLTSSSGELWRMVRIGGQPLGFDECGIVAQIAGPLAAADISAYYISTFNFDHALVPEDGIGSVIEVLQRRQEGLAS

SEQ ID NO: 34246 - protein, 291 aa, Homo sapiens
  Payload ID: 6765
  Gene Symbol: GATSL3
  Gene Name: GATS protein-like 3
  ENSP ID: ENSP00000385868
MELHILEHRVRVLSVARPGLWLYTHPLIKLLFLPRRSRCKFFSLTETPEDYTLMVDEEGFKELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHRFPSDLLLTSSSGELWRMVRIGGQPLGFDECGIVAQIAGPLAAADISAYYISTFNFDHALVPEDGIGSVIEVLQRRQEGLAS

SEQ ID NO: 34247 - protein, 42 aa, Homo sapiens
  Payload ID: 6765
  Gene Symbol: GATSL3
  Gene Name: GATS protein-like 3
  ENSP ID: ENSP00000390869
MELHILEHRVRVLSVARPGLWLYTHPLIKLLFLPRRSRAAPI

SEQ ID NO: 34248 - protein, 62 aa, Homo sapiens
  Payload ID: 6765
  Gene Symbol: GATSL3
  Gene Name: GATS protein-like 3
  ENSP ID: ENSP00000407871
  MOD_RES (1)..(1): Any amino acid
XELHILEHRVRVLSVARPGLWLYTHPLIKLLFLPRRSRCAPGFGSADRGWGLCSRSGPGSED

SEQ ID NO: 34249 - protein, 62 aa, Homo sapiens
  Payload ID: 6765
  Gene Symbol: GATSL3
  Gene Name: GATS protein-like 3
  ENSP ID: ENSP00000408419
MELHILEHRVRVLSVARPGLWLYTHPLIKLLFLPRRSRCAPGFGSADRGWGLCSRSGPGSED

SEQ ID NO: 34250 - protein, 42 aa, Homo sapiens; identical to SEQ ID NO: 34247
  Payload ID: 6765
  Gene Symbol: GATSL3
  Gene Name: GATS protein-like 3
  ENSP ID: ENSP00000411842

SEQ ID NO: 34251 - protein, 74 aa, Homo sapiens
  Payload ID: 6765
  Gene Symbol: GATSL3
  Gene Name: GATS protein-like 3
  ENSP ID: ENSP00000416041
MELHILEHRVRVLSVARPGLWLYTHPLIKLLFLPRRSRCKFFSLTETPEDYTLMVDEEGFKDEETETQITHPRS

SEQ ID NO: 34252 - protein, 163 aa, Homo sapiens
  Payload ID: 6766
  Gene Symbol: GATS
  Gene Name: GATS, stromal antigen 3 opposite strand
  Uniprot ID: Q8NAP1
  ENSP ID: ENSP00000389760
MSCRGRGAGGRWNSTSWSTGCKLPASPRRVSRCSPTGLIKLAFLFSKTRCKFFSLTETPEDYTIIVDEEGFLELPSSEHLSVADATWLALNVVSGGGSFSSSQPIGMTKIAKSVIAPLADQNISVFMLSTYQTDFILVLKRDLPFVTHTLSSEFTILWSVARL

SEQ ID NO: 34253 - protein, 185 aa, Homo sapiens
  Payload ID: 6766
  Gene Symbol: GATS
  Gene Name: GATS, stromal antigen 3 opposite strand
  ENSP ID: ENSP00000479181
MSCRGRGAGGRWNSTSWSTGCKLPASPRRVSRCSPTGLIKLAFLFSKTRCKFFSLTETPEDYTIIVDEEGFLELPSSEHLSVADATWLALNVVSGGGSFSSSQPIGMTKIAKSVIAPLADQNISVFMLSTYQTDFILSRCRSSTHCPARATGSVSPAWTPTRCLLLPHSSWMSCPTSMGPWCTLL

SEQ ID NO: 34254 - protein, 163 aa, Homo sapiens; identical to SEQ ID NO: 34252
  Payload ID: 6766
  Gene Symbol: GATS
  Gene Name: GATS, stromal antigen 3 opposite strand
  Uniprot ID: Q8NAP1
  ENSP ID: ENSP00000479420

SEQ ID NO: 34255 - protein, 163 aa, Homo sapiens; identical to SEQ ID NO: 34252
  Payload ID: 6766
  Gene Symbol: GATS
  Gene Name: GATS, stromal antigen 3 opposite strand
  Uniprot ID: Q8NAP1
  ENSP ID: ENSP00000479781

SEQ ID NO: 34256 - protein, 163 aa, Homo sapiens; identical to SEQ ID NO: 34252
  Payload ID: 6766
  Gene Symbol: GATS
  Gene Name: GATS, stromal antigen 3 opposite strand
  Uniprot ID: Q8NAP1
  ENSP ID: ENSP00000481377

SEQ ID NO: 34257 - protein, 163 aa, Homo sapiens; identical to SEQ ID NO: 34252
  Payload ID: 6766
  Gene Symbol: GATS
  Gene Name: GATS, stromal antigen 3 opposite strand
  Uniprot ID: Q8NAP1
  ENSP ID: ENSP00000482429

SEQ ID NO: 34258 - protein, 2671 aa, Homo sapiens
  Payload ID: 6767
  Gene Symbol: GCN1
  Gene Name: GCN1 eIF2 alpha kinase activator homolog
  Uniprot ID: Q92616
  ENSP ID: ENSP00000300648
MAADTQVSETLKRFAGKVTTASVKERREILSELGKCVAGKDLPEGAVKGLCKLFCLTLHRYRDAASRRALQAAIQQLAEAQPEATAKNLLHSLQSSGIGSKAGVPSKSSGSAALLALTWTCLLVRIVFPSRAKRQGDIWNKLVEVQCLLLLEVLGGSHKHAVDGAVKKLTKLWKENPGLVEQYLSAILSLEPNQNYAGMLGLLVQFCTSHKEMDVVSQHKSALLDFYMKNILMSKVKPPKYLLDSCAPLLRYLSHSEFKDLILPTIQKSLLRSPENVIETISSLLASVTLDLSQYAMDIVKGLAGHLKSNSPRLMDEAVLALRNLARQCSDSSAMESLTKHLFAILGGSEGKLTVVAQKMSVLSGIGSVSHHVVSGPSSQVLNGIVAELFIPFLQQEVHEGTLVHAVSVLALWCNRFTMEVPKKLTEWFKKAFSLKTSTSAVRHAYLQCMLASYRGDTLLQALDLLPLLIQTVEKAASQSTQVPTITEGVAAALLLLKLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLVAVQSGLWPALLARMKIDPEAFITRHLDQIIPRMTTQSPLNQSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 34259 - protein, 480 aa, Homo sapiens
  Payload ID: 6768
  Gene Symbol: GPBP1
  Gene Name: GC-rich promoter binding protein 1
  Uniprot ID: Q86WP2
  ENSP ID: ENSP00000264779
MAQHDFAPAWLNFPTPPSSTKVLTSSLKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 34260 - protein, 493 aa, Homo sapiens
  Payload ID: 6768
  Gene Symbol: GPBP1
  Gene Name: GC-rich promoter binding protein 1
  ENSP ID: ENSP00000401596
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWGLHAQTHTYPTKKISQAPLLEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 34261 - protein, 473 aa, Homo sapiens
  Payload ID: 6768
  Gene Symbol: GPBP1
  Gene Name: GC-rich promoter binding protein 1
  Uniprot ID: Q86WP2
  ENSP ID: ENSP00000421202
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 34262 - protein, 302 aa, Homo sapiens
  Payload ID: 6768
  Gene Symbol: GPBP1
  Gene Name: GC-rich promoter binding protein 1
  Uniprot ID: Q86WP2
  ENSP ID: ENSP00000421709
MLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 34263 - protein, 465 aa, Homo sapiens
  Payload ID: 6768
  Gene Symbol: GPBP1
  Gene Name: GC-rich promoter binding protein 1
  Uniprot ID: Q86WP2
  ENSP ID: ENSP00000422337
MAQHDFAPAWLNFPTPPSSTKVLTSSLKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKEQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 34264 - protein, 474 aa, Homo sapiens
  Payload ID: 6769
  Gene Symbol: GPBP1L1
  Gene Name: GC-rich promoter binding protein 1-like 1
  Uniprot ID: Q9HC44
  ENSP ID: ENSP00000290795
MAQHDFVPAWLNFSTPQSAKSPTATFEKHGEHLPRGEGRFGVSRRRHNSSDGFFNNGPLRTAGDSWHQPSLFRHDSVDSGVSKGAYAGITGNPSGWHSSSRGHDGMSQRSGGGTGNHRHWNGSFHSRKGCAFQEKPPMEIREEKKEDKVEKLQFEEEDFPSLNPEAGKQHQPCRPIGTPSGVWENPPSAKQPSKMLVIKKVSKEDPAAAFSAAFTSPGSHHANGNKLSSVVPSVYKNLVPKPVPPPSKPNAWKANRMEHKSGSLSSSRESAFTSPISVTKPVVLASGAALSSPKESPSSTTPPIEISSSRLTKLTRRTTDRKSEFLKTLKDDRNGDFSENRDCDKLEDLEDNSTPEPKENGEEGCHQNGLALPVVEEGEVLSHSLEAEHRLLKAMGWQEYPENDENCLPLTEDELKEFHMKTEQLRRNGFGKNGFLQSRSSSLFSPWRSTCKAEFEDSDTETSSSETSDDDAWK

SEQ ID NO: 34265 - protein, 474 aa, Homo sapiens; identical to SEQ ID NO: 34264
  Payload ID: 6769
  Gene Symbol: GPBP1L1
  Gene Name: GC-rich promoter binding protein 1-like 1
  Uniprot ID: Q9HC44
  ENSP ID: ENSP00000347224

SEQ ID NO: 34266 - protein, 781 aa, Homo sapiens
  Payload ID: 6770
  Gene Symbol: GCFC2
  Gene Name: GC-rich sequence DNA-binding factor 2
  Uniprot ID: P16383
  ENSP ID: ENSP00000318690
MAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGNGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 34267 - protein, 743 aa, Homo sapiens
  Payload ID: 6770
  Gene Symbol: GCFC2
  Gene Name: GC-rich sequence DNA-binding factor 2
  Uniprot ID: P16383
  ENSP ID: ENSP00000386552
MAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISVSRNEETSEESQEDEKQDTWEQQQMRKAVKIIEERDIDLSCGNGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 34268 - protein, 199 aa, Homo sapiens
  Payload ID: 6770
  Gene Symbol: GCFC2
  Gene Name: GC-rich sequence DNA-binding factor 2
  ENSP ID: ENSP00000409340
KVVQIKKSCLQSSTKQLFPDLQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 34269 - protein, 185 aa, Homo sapiens
  Payload ID: 6770
  Gene Symbol: GCFC2
  Gene Name: GC-rich sequence DNA-binding factor 2
  ENSP ID: ENSP00000415831
MAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVSRNEETSEESQEDEKQDTWEQQQMRKAVKIIEERDIDLSCGNGSSKVKKFDTS

SEQ ID NO: 34270 - protein, 254 aa, Homo sapiens
  Payload ID: 6770
  Gene Symbol: GCFC2
  Gene Name: GC-rich sequence DNA-binding factor 2
  Uniprot ID: P16383
  ENSP ID: ENSP00000437767
MAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEINITTGNSPLTPEGV

SEQ ID NO: 34271 - protein, 35 aa, Homo sapiens
  Payload ID: 6770
  Gene Symbol: GCFC2
  Gene Name: GC-rich sequence DNA-binding factor 2
  ENSP ID: ENSP00000474136
ADEGSGVQGDAGKRGGDGTGREGAAGSLDPSLGVL

SEQ ID NO: 34272 - protein, 215 aa, Homo sapiens
  Payload ID: 6770
  Gene Symbol: GCFC2
  Gene Name: GC-rich sequence DNA-binding factor 2
  Uniprot ID: P16383
  ENSP ID: ENSP00000474481
MAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESSMDLPIYED

SEQ ID NO: 34273 - protein, 27 aa, Homo sapiens
  Payload ID: 6770
  Gene Symbol: GCFC2
  Gene Name: GC-rich sequence DNA-binding factor 2
  ENSP ID: ENSP00000475108
  MOD_RES (1)..(1): Any amino acid
XLLNRYLIIALLNATPGPDVVKKCNQG

SEQ ID NO: 34274 - protein, 43 aa, Homo sapiens
  Payload ID: 6770
  Gene Symbol: GCFC2
  Gene Name: GC-rich sequence DNA-binding factor 2
  ENSP ID: ENSP00000475130
  MOD_RES (1)..(1): Any amino acid
XSEFRDEVEEIILILVKIKALNQAESFIGEHHLDHLKSLIKED

SEQ ID NO: 34275 - protein, 465 aa, Homo sapiens
  Payload ID: 6771
  Gene Symbol: GFRA1
  Gene Name: GDNF family receptor alpha 1
  Uniprot ID: P56159
  ENSP ID: ENSP00000347591
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISDVFQQVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 34276 - protein, 465 aa, Homo sapiens; identical to SEQ ID NO: 34275
  Payload ID: 6771
  Gene Symbol: GFRA1
  Gene Name: GDNF family receptor alpha 1
  Uniprot ID: P56159
  ENSP ID: ENSP00000358237

SEQ ID NO: 34277 - protein, 460 aa, Homo sapiens
  Payload ID: 6771
  Gene Symbol: GFRA1
  Gene Name: GDNF family receptor alpha 1
  Uniprot ID: P56159
  ENSP ID: ENSP00000358239
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 34278 - protein, 460 aa, Homo sapiens; identical to SEQ ID NO: 34277
  Payload ID: 6771
  Gene Symbol: GFRA1
  Gene Name: GDNF family receptor alpha 1
  Uniprot ID: P56159
  ENSP ID: ENSP00000393725

SEQ ID NO: 34279 - protein, 62 aa, Homo sapiens
  Payload ID: 6772
  Gene Symbol: GFRA2
  Gene Name: GDNF family receptor alpha 2
  ENSP ID: ENSP00000306654
MILANVFCLFFFLGPGPLLRRNGVQREKTCSYIQGRMMPEFSLGYEEGCPTESPWCALAKWV

SEQ ID NO: 34280 - protein, 464 aa, Homo sapiens
  Payload ID: 6772
  Gene Symbol: GFRA2
  Gene Name: GDNF family receptor alpha 2
  Uniprot ID: O00451
  ENSP ID: ENSP00000428518
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 34281 - protein, 264 aa, Homo sapiens
  Payload ID: 6772
  Gene Symbol: GFRA2
  Gene Name: GDNF family receptor alpha 2
  ENSP ID: ENSP00000428721
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLC

SEQ ID NO: 34282 - protein, 331 aa, Homo sapiens
  Payload ID: 6772
  Gene Symbol: GFRA2
  Gene Name: GDNF family receptor alpha 2
  Uniprot ID: O00451
  ENSP ID: ENSP00000429206
MILANVFCLFFFLGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 34283 - protein, 464 aa, Homo sapiens; identical to SEQ ID NO: 34280
  Payload ID: 6772
  Gene Symbol: GFRA2
  Gene Name: GDNF family receptor alpha 2
  Uniprot ID: O00451
  ENSP ID: ENSP00000429445

SEQ ID NO: 34284 - protein, 359 aa, Homo sapiens
  Payload ID: 6772
  Gene Symbol: GFRA2
  Gene Name: GDNF family receptor alpha 2
  Uniprot ID: O00451
  ENSP ID: ENSP00000429979
MILANVFCLFFFLGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 34285 - protein, 74 aa, Homo sapiens
  Payload ID: 6772
  Gene Symbol: GFRA2
  Gene Name: GDNF family receptor alpha 2
  ENSP ID: ENSP00000430622
MLANKECQAALEVLQESPLYDCRCKRGMKKELQCLQIYWSIHLGLTEGEEFYEASPYEPVTSRLSDIFRLASIF

SEQ ID NO: 34286 - protein, 400 aa, Homo sapiens
  Payload ID: 6773
  Gene Symbol: GFRA3
  Gene Name: GDNF family receptor alpha 3
  Uniprot ID: O60609
  ENSP ID: ENSP00000274721
MVRPLNPRPLPPVVLMLLLLLPPSPLPLAAGDPLPTESRLMNSCLQARRKCQADPTCSAAYHHLDSCTSSISTPLPSEEPSVPADCLEAAQQLRNSSLIGCMCHRRMKNQVACLDIYWTVHRARSLGNYELDVSPYEDTVTSKPWKMNLSKLNMLKPDSDLCLKFAMLCTLNDKCDRLRKAYGEACSGPHCQRHVCLRQLLTFFEKAAEPHAQGLLLCPCAPNDRGCGERRRNTIAPNCALPPVAPNCLELRRLCFSDPLCRSRLVDFQTHCHPMDILGTCATEQSRCLRAYLGLIGTAMTPNFVSNVNTSVALSCTCRGSGNLQEECEMLEGFFSHNPCLTEAIAAKMRFHSQLFSQDWPHPTFAVMAHQNENPAVRPQPWVPSLFSCTLPLILLLSLW

SEQ ID NO: 34287 - protein, 369 aa, Homo sapiens
  Payload ID: 6773
  Gene Symbol: GFRA3
  Gene Name: GDNF family receptor alpha 3
  Uniprot ID: O60609
  ENSP ID: ENSP00000367613
MVRPLNPRPLPPVVLMLLLLLPPSPLPLAAGDPLPTESRLMNSCLQARRKCQADPTCSAAYHHLDSCTSSISTPLPSEEPSVPADCLEAAQQLRNSSLIGCMCHRRMKNQVACLDIYWTVHRARSLDSDLCLKFAMLCTLNDKCDRLRKAYGEACSGPHCQRHVCLRQLLTFFEKAAEPHAQGLLLCPCAPNDRGCGERRRNTIAPNCALPPVAPNCLELRRLCFSDPLCRSRLVDFQTHCHPMDILGTCATEQSRCLRAYLGLIGTAMTPNFVSNVNTSVALSCTCRGSGNLQEECEMLEGFFSHNPCLTEAIAAKMRFHSQLFSQDWPHPTFAVMAHQNENPAVRPQPWVPSLFSCTLPLILLLSLW

SEQ ID NO: 34288 - protein, 269 aa, Homo sapiens
  Payload ID: 6774
  Gene Symbol: GFRA4
  Gene Name: GDNF family receptor alpha 4
  Uniprot ID: Q9GZZ7
  ENSP ID: ENSP00000290417
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRPRLLAFQVSCTPAPSAPDGCLLDQGARCLRAYAGLVGTAVTPNYVDNVSARVAPWCDCGASGNRREDCEAFRGLFTRNRCLDGAIQAFASGWPPVLLDQLNPQGDPEHSLLQVSSTGRALERRSLLSILPVLALPALL

SEQ ID NO: 34289 - protein, 299 aa, Homo sapiens
  Payload ID: 6774
  Gene Symbol: GFRA4
  Gene Name: GDNF family receptor alpha 4
  Uniprot ID: Q9GZZ7
  ENSP ID: ENSP00000313423
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRCARAAAGPWRGWGRGLSPAHRPPAAQASPPGLSGLVHPSAQRPRRLPAGPGRPLPARLRGPRGVPAGTAVTPNYVDNVSARVAPWCDCGASGNRREDCEAFRGLFTRNRCLDGAIQAFASGWPPVLLDQLNPQGDPEHSLLQVSSTGRALERRSLLSILPVLALPALL

SEQ ID NO: 34290 - protein, 182 aa, Homo sapiens
  Payload ID: 6774
  Gene Symbol: GFRA4
  Gene Name: GDNF family receptor alpha 4
  Uniprot ID: Q9GZZ7
  ENSP ID: ENSP00000435801
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRPRLLAFQVSCTPAPSAPDGCLLDQGARCLRAYAGLVGSPQAPPSPLTTWTT

SEQ ID NO: 34291 - protein, 394 aa, Homo sapiens
  Payload ID: 6775
  Gene Symbol: GFRAL
  Gene Name: GDNF family receptor alpha like
  Uniprot ID: Q6UXV0
  ENSP ID: ENSP00000343636
MIVFIFLAMGLSLENEYTSQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSSIQIPGEL

SEQ ID NO: 34292 - protein, 711 aa, Homo sapiens
  Payload ID: 6776
  Gene Symbol: GZF1
  Gene Name: GDNF-inducible zinc finger protein 1
  Uniprot ID: Q9H116
  ENSP ID: ENSP00000338290
MESGAVLLESKSSPFNLLHEMHELRLLGHLCDVTVSVEYQGVRKDFMAHKAVLAATSKFFKEVFLNEKSVDGTRTNVYLNEVQVADFASFLEFVYTAKVQVEEDRVQRMLEVAEKLKCLDLSETCFQLKKQMLESVLLELQNFSESQEVEVSSGSQVSAAPAPRASVATDGPHPSGLTDSLDYPGERASNGMSSDLPPKKSKDKLDKKKEVVKPPYPKIRRASGRLAGRKVFVEIPKKKYTRRLREQQKTAEGDVGDYRCPQDQSPDRVGTEMEQVSKNEGCQAGAELEELSKKAGPEEEEEEEEEDEEGEKKKSNFKCSICEKAFLYEKSFLKHSKHRHGVATEVVYRCDTCGQTFANRCNLKSHQRHVHSSERHFPCELCGKKFKRKKDVKRHVLQVHEGGGERHRCGQCGKGLSSKTALRLHERTHTGDRPYGCTECGARFSQPSALKTHMRIHTGEKPFVCDECGARFTQNHMLIYHKRCHTGERPFMCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 34293 - protein, 711 aa, Homo sapiens; identical to SEQ ID NO: 34292
  Payload ID: 6776
  Gene Symbol: GZF1
  Gene Name: GDNF-inducible zinc finger protein 1
  Uniprot ID: Q9H116
  ENSP ID: ENSP00000366250

SEQ ID NO: 34294 - protein, 48 aa, Homo sapiens
  Payload ID: 6776
  Gene Symbol: GZF1
  Gene Name: GDNF-inducible zinc finger protein 1
  ENSP ID: ENSP00000410009
MESGAVLLESKSSPFNLLHEMHELRLLGHLCDVTVSVEYQGVRKDFMA

SEQ ID NO: 34295 - protein, 447 aa, Homo sapiens [sequence omitted]

SEQ ID NO: 34296 - protein, 40 aa, Homo sapiens
  Payload ID: 6777
  Gene Symbol: GDI1
  Gene Name: GDP dissociation inhibitor 1
  ENSP ID: ENSP00000394752
MDEEYDVIVLGTGLTERRQVGVQRMVSPSPRNASCRASCL

SEQ ID NO: 34297 - protein, 46 aa, Homo sapiens
  Payload ID: 6777
  Gene Symbol: GDI1
  Gene Name: GDP dissociation inhibitor 1
  ENSP ID: ENSP00000396215
MDEEYDVIVLGTGLTMPLGVLVLEGHPVSAGCPASLKASVISLSAL

SEQ ID NO: 34298 - protein, 147 aa, Homo sapiens
  Payload ID: 6777
  Gene Symbol: GDI1
  Gene Name: GDP dissociation inhibitor 1
  ENSP ID: ENSP00000416195
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASRPPLNPRDIAKCLSQEGP

SEQ ID NO: 34299 - protein, 147 aa, Homo sapiens; identical to SEQ ID NO: 34298
  Payload ID: 6777
  Gene Symbol: GDI1
  Gene Name: GDP dissociation inhibitor 1
  ENSP ID: ENSP00000486715

SEQ ID NO: 34300 - protein, 148 aa, Homo sapiens
  Payload ID: 6778
  Gene Symbol: GDI2
  Gene Name: GDP dissociation inhibitor 2
  ENSP ID: ENSP00000369470
MSLGKRKPSNFYLANFLGKECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFL

SEQ ID NO: 34301 - protein, 400 aa, Homo sapiens
  Payload ID: 6778
  Gene Symbol: GDI2
  Gene Name: GDP dissociation inhibitor 2
  Uniprot ID: P50395
  ENSP ID: ENSP00000369528
MNEEYDVIVLGTGLTECILSGIMSVNGKKVLHMDRNPYYGGESASITPLEDLYKRFKIPGSPPESMGRGRDWNVDLIPKFLMANGLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 34302 - protein, 445 aa, Homo sapiens
  Payload ID: 6778
  Gene Symbol: GDI2
  Gene Name: GDP dissociation inhibitor 2
  Uniprot ID: P50395
  ENSP ID: ENSP00000369538
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 34303 - protein, 203 aa, Homo sapiens
  Payload ID: 6778
  Gene Symbol: GDI2
  Gene Name: GDP dissociation inhibitor 2
  ENSP ID: ENSP00000387565
KKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDLLASVTSWYQKTWEQKARSLFPAHMMPPLILRQRVMTLKTSIRG

SEQ ID NO: 34304 - protein, 155 aa, Homo sapiens
  Payload ID: 6778
  Gene Symbol: GDI2
  Gene Name: GDP dissociation inhibitor 2
  ENSP ID: ENSP00000394177
MNEEYDVIVLGTGLTLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALAL

SEQ ID NO: 34305 - protein, 263 aa, Homo sapiens
  Payload ID: 6778
  Gene Symbol: GDI2
  Gene Name: GDP dissociation inhibitor 2
  ENSP ID: ENSP00000401733
MNEEYDVIVLGTGLTECILSGIMSVNGKKVLHMDRNPYYGGESASITPLEDLYKRFKIPGSPPESMGRGRDWNVDLIPKFLMANEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGE

SEQ ID NO: 34306 - protein, 130 aa, Homo sapiens
  Payload ID: 6778
  Gene Symbol: GDI2
  Gene Name: GDP dissociation inhibitor 2
  ENSP ID: ENSP00000476707
MSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDE

SEQ ID NO: 34307 - protein, 125 aa, Homo sapiens
  Payload ID: 6778
  Gene Symbol: GDI2
  Gene Name: GDP dissociation inhibitor 2
  ENSP ID: ENSP00000476832
MSLGKRKPSNFYLANFLGKECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPS

SEQ ID NO: 34308 - protein, 385 aa, Homo sapiens
  Payload ID: 6779
  Gene Symbol: GDPGP1
  Gene Name: GDP-D-glucose phosphorylase 1
  Uniprot ID: Q6ZNW5
  ENSP ID: ENSP00000368405
MALPHDSNETSYLLPPNNEDWGRQTIPDFVYGQKDLMAEGIQWPRNAPGIPDALPQSPFDAALCSAWKQRVELGLFRYRLRELQTQILPGAVGFVAQLNVERGVQRRPPQTIKSVRQAFDPVQFNFNKIRPGEVLFRLHREPDLPGTLLQEDILVVINVSPLEWGHVLLVPEPARQLPQRLLPGALRAGIEAVLLSLHPGFRVGFNSLGGLASVNHLHLHGYYLAHRLPVEQAPSEPLDPGGHLHLLQDLPAPGFLFYTRGPGPDLESLISRVCRATDYLTDHEIAHNLFVTRGAPPGKTSPSSALTGVRVILWARKSSFGIKDGEAFNVALCELAGHLPVKTSQDFSSLTEAAAVALIQDCRLPPSQAEDVQAALVALMSQEEQ

SEQ ID NO: 34309 - protein, 385 aa, Homo sapiens; identical to SEQ ID NO: 34308
  Payload ID: 6779
  Gene Symbol: GDPGP1
  Gene Name: GDP-D-glucose phosphorylase 1
  Uniprot ID: Q6ZNW5
  ENSP ID: ENSP00000452793

SEQ ID NO: 34310 - protein, 49 aa, Homo sapiens
  Payload ID: 6779
  Gene Symbol: GDPGP1
  Gene Name: GDP-D-glucose phosphorylase 1
  ENSP ID: ENSP00000453037
MALPHDSNETSYLLPPNNEDWGRQTIPDFVYGQKDLMAEGIQWPRNAPG

SEQ ID NO: 34311 - protein, 214 aa, Homo sapiens
  Payload ID: 6779
  Gene Symbol: GDPGP1
  Gene Name: GDP-D-glucose phosphorylase 1
  ENSP ID: ENSP00000453822
MALPHDSNETSYLLPPNNEDWGRQTIPDFVYGQKDLMAEGIQWPRNAPGIPDALPQSPFDAALCSAWKQRVELGLFRYRLRELQTQILPGAVGFVAQLNVERGVQRRPPQTIKSVRQAFDPVQFNFNKIRPGEVLFRLHREPDLPGTLLQEDILVVINVSPLEWGHVLLVPEPARQLPQRLLPGALRAGIEAVLLSLHPGFRVGFNSLGGLASV

SEQ ID NO: 34312 - protein, 10 aa, Homo sapiens
  Payload ID: 6779
  Gene Symbol: GDPGP1
  Gene Name: GDP-D-glucose phosphorylase 1
  ENSP ID: ENSP00000454128
MALPHDSNET

SEQ ID NO: 34313 - protein, 372 aa, Homo sapiens
  Payload ID: 6780
  Gene Symbol: GMDS
  Gene Name: GDP-mannose 4,6-dehydratase
  Uniprot ID: O60547
  ENSP ID: ENSP00000370194
MAHAPARCPSARGSGDGEMGKPRNVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVDFLQGDCTKAKQKLNWKPRVAFDELVREMVHADVELMRTNPNA

SEQ ID NO: 34314 - protein, 342 aa, Homo sapiens
  Payload ID: 6780
  Gene Symbol: GMDS
  Gene Name: GDP-mannose 4,6-dehydratase
  Uniprot ID: O60547
  ENSP ID: ENSP00000436726
MCKMDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVDFLQGDCTKAKQKLNWKPRVAFDELVREMVHADVELMRTNPNA

SEQ ID NO: 34315 - protein, 420 aa, Homo sapiens
  Payload ID: 6781
  Gene Symbol: GMPPA
  Gene Name: GDP-mannose pyrophosphorylase A
  Uniprot ID: Q96IJ6
  ENSP ID: ENSP00000315925
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGCRVRIPAEVLILNSIVLPHKELSRSFTNQIIL

SEQ ID NO: 34316 - protein, 420 aa, Homo sapiens; identical to SEQ ID NO: 34315
  Payload ID: 6781
  Gene Symbol: GMPPA
  Gene Name: GDP-mannose pyrophosphorylase A
  Uniprot ID: Q96IJ6
  ENSP ID: ENSP00000340760

SEQ ID NO: 34317 - protein, 420 aa, Homo sapiens; identical to SEQ ID NO: 34315
  Payload ID: 6781
  Gene Symbol: GMPPA
  Gene Name: GDP-mannose pyrophosphorylase A
  Uniprot ID: Q96IJ6
  ENSP ID: ENSP00000350949

SEQ ID NO: 34318 - protein, 420 aa, Homo sapiens; identical to SEQ ID NO: 34315
  Payload ID: 6781
  Gene Symbol: GMPPA
  Gene Name: GDP-mannose pyrophosphorylase A
  Uniprot ID: Q96IJ6
  ENSP ID: ENSP00000363016

SEQ ID NO: 34319 - protein, 473 aa, Homo sapiens
  Payload ID: 6781
  Gene Symbol: GMPPA
  Gene Name: GDP-mannose pyrophosphorylase A
  Uniprot ID: Q96IJ6
  ENSP ID: ENSP00000363027
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGTQPAPIPNLWLPPQPSEPGFLTSSPELKPQSLPLPDQIRFGIFAPRASLLLLGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGCRVRIPAEVLILNSIVLPHKELSRSFTNQIIL

SEQ ID NO: 34320 - protein, 179 aa, Homo sapiens
  Payload ID: 6781
  Gene Symbol: GMPPA
  Gene Name: GDP-mannose pyrophosphorylase A
  ENSP ID: ENSP00000392465
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDII

SEQ ID NO: 34321 - protein, 290 aa, Homo sapiens
  Payload ID: 6781
  Gene Symbol: GMPPA
  Gene Name: GDP-mannose pyrophosphorylase A
  ENSP ID: ENSP00000396750
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGPLFCF

SEQ ID NO: 34322 - protein, 249 aa, Homo sapiens
  Payload ID: 6781
  Gene Symbol: GMPPA
  Gene Name: GDP-mannose pyrophosphorylase A
  ENSP ID: ENSP00000411060
MIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIR

SEQ ID NO: 34323 - protein, 399 aa, Homo sapiens
  Payload ID: 6781
  Gene Symbol: GMPPA
  Gene Name: GDP-mannose pyrophosphorylase A
  ENSP ID: ENSP00000478700
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGNVYIHPTAKVAPSAVLGPNVSIGKGVTVGEGVRLRESIVLHGATLQEHTCVLHSIVGWGSTVGRWARVEVPPVTLTPTIPEPAWTVRASSRTGSCCLLSPSWAAESGSLPRCSS

SEQ ID NO: 34324 - protein, 114 aa, Homo sapiens
  Payload ID: 6781
  Gene Symbol: GMPPA
  Gene Name: GDP-mannose pyrophosphorylase A
  ENSP ID: ENSP00000489451
  MOD_RES (1)..(1): Any amino acid
XIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGMASWGPGLGEPLS

SEQ ID NO: 34325 - protein, 387 aa, Homo sapiens
  Payload ID: 6782
  Gene Symbol: GMPPB
  Gene Name: GDP-mannose pyrophosphorylase B
  Uniprot ID: Q9Y5P6
  ENSP ID: ENSP00000309092
MKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLQRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVSLWAGLGGERGGECACLPDKAYPLLEVRMENVTVLGEDVIVNDELYLNGASVLPHKSIGESVPEPRIIM

SEQ ID NO: 34326 - protein, 360 aa, Homo sapiens
  Payload ID: 6782
  Gene Symbol: GMPPB
  Gene Name: GDP-mannose pyrophosphorylase B
  Uniprot ID: Q9Y5P6
  ENSP ID: ENSP00000311130
MKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLQRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVRMENVTVLGEDVIVNDELYLNGASVLPHKSIGESVPEPRIIM

SEQ ID NO: 34327 - protein, 360 aa, Homo sapiens; identical to SEQ ID NO: 34326
  Payload ID: 6782
  Gene Symbol: GMPPB
  Gene Name: GDP-mannose pyrophosphorylase B
  Uniprot ID: Q9Y5P6
  ENSP ID: ENSP00000418565

SEQ ID NO: 34328 - protein, 731 aa, Homo sapiens
  Payload ID: 6783
  Gene Symbol: GSN
  Gene Name: gelsolin
  Uniprot ID: P06396
  ENSP ID: ENSP00000340888
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 34329 - protein, 67 aa, Homo sapiens
  Payload ID: 6783
  Gene Symbol: GSN
  Gene Name: gelsolin
  ENSP ID: ENSP00000362912
  MOD_RES (1)..(1): Any amino acid
XKGGTSREGGQTAPASTRLFQVRANSAGATRAVEVISRSWNTEGIGLPETSQLNDQISRHRNGGRGW

SEQ ID NO: 34330 - protein, 731 aa, Homo sapiens; identical to SEQ ID NO: 34328
  Payload ID: 6783
  Gene Symbol: GSN
  Gene Name: gelsolin
  Uniprot ID: P06396
  ENSP ID: ENSP00000362914

SEQ ID NO: 34331 - protein, 782 aa, Homo sapiens
  Payload ID: 6783
  Gene Symbol: GSN
  Gene Name: gelsolin
  Uniprot ID: P06396
  ENSP ID: ENSP00000362924
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 34332 - protein, 731 aa, Homo sapiens; identical to SEQ ID NO: 34328
  Payload ID: 6783
  Gene Symbol: GSN
  Gene Name: gelsolin
  Uniprot ID: P06396
  ENSP ID: ENSP00000362929

SEQ ID NO: 34333 - protein, 748 aa, Homo sapiens
  Payload ID: 6783
  Gene Symbol: GSN
  Gene Name: gelsolin
  ENSP ID: ENSP00000377882
MAEEEALRGNSDPWPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 34334 - protein, 260 aa, Homo sapiens
  Payload ID: 6783
  Gene Symbol: GSN
  Gene Name: gelsolin
  ENSP ID: ENSP00000404226
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMS

SEQ ID NO: 34335 - protein, 767 aa, Homo sapiens
  Payload ID: 6783
  Gene Symbol: GSN
  Gene Name: gelsolin
  ENSP ID: ENSP00000409358
MNTGLTRLLWPSWLPDGDMSHPQPELFLFPKAQPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 34336 - protein, 228 aa, Homo sapiens
  Payload ID: 6783
  Gene Symbol: GSN
  Gene Name: gelsolin
  ENSP ID: ENSP00000410657
MEKLFCCFPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPE

SEQ ID NO: 34337 - protein, 742 aa, Homo sapiens
  Payload ID: 6783
  Gene Symbol: GSN
  Gene Name: gelsolin
  Uniprot ID: P06396
  ENSP ID: ENSP00000411293
MEKLFCCFPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 34338 - protein, 731 aa, Homo sapiens; identical to SEQ ID NO: 34328
  Payload ID: 6783
  Gene Symbol: GSN
  Gene Name: gelsolin
  Uniprot ID: P06396
  ENSP ID: ENSP00000416586

SEQ ID NO: 34339 - protein, 739 aa, Homo sapiens
  Payload ID: 6783
  Gene Symbol: GSN
  Gene Name: gelsolin
  Uniprot ID: P06396
  ENSP ID: ENSP00000445823
MPLCTPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 34340 - protein, 232 aa, Homo sapiens
  Payload ID: 6783
  Gene Symbol: GSN
  Gene Name: gelsolin
  ENSP ID: ENSP00000489067
MEKLFCCFPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQ

SEQ ID NO: 34341 - protein, 265 aa, Homo sapiens
  Payload ID: 6784
  Gene Symbol: GEMIN2
  Gene Name: gem (nuclear organelle) associated protein 2
  Uniprot ID: O14893
  ENSP ID: ENSP00000250379
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQATVTSVLEYLSNWFGERDFTPELGRWLYALLACLEKPLLPEAHSLIRQLARRCSEVRLLVDSKDDERVPALNLLICLVSRYFDQRDLADEPS

SEQ ID NO: 34342 - protein, 280 aa, Homo sapiens
  Payload ID: 6784
  Gene Symbol: GEMIN2
  Gene Name: gem (nuclear organelle) associated protein 2
  Uniprot ID: O14893
  ENSP ID: ENSP00000308533
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVDSKDDERVPALNLLICLVSRYFDQRDLADEPS

SEQ ID NO: 34343 - protein, 250 aa, Homo sapiens
  Payload ID: 6784
  Gene Symbol: GEMIN2
  Gene Name: gem (nuclear organelle) associated protein 2
  Uniprot ID: O14893
  ENSP ID: ENSP00000379548
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVVF

SEQ ID NO: 34344 - protein, 44 aa, Homo sapiens
  Payload ID: 6784
  Gene Symbol: GEMIN2
  Gene Name: gem (nuclear organelle) associated protein 2
  Uniprot ID: O14893
  ENSP ID: ENSP00000416827
MRRAELAGLKTMAWVPAESAVEELMPRLLPDRSSSMSRCCGSSN

SEQ ID NO: 34345 - protein, 45 aa, Homo sapiens
  Payload ID: 6784
  Gene Symbol: GEMIN2
  Gene Name: gem (nuclear organelle) associated protein 2
  ENSP ID: ENSP00000431500
  MOD_RES (1)..(1): Any amino acid
XLAGLKTMAWVPAESAVEELMPRLLPVEPCDLTEGSKQLNVQMLW

SEQ ID NO: 34346 - protein, 197 aa, Homo sapiens
  Payload ID: 6784
  Gene Symbol: GEMIN2
  Gene Name: gem (nuclear organelle) associated protein 2
  ENSP ID: ENSP00000434048
  MOD_RES (1)..(1): Any amino acid
XKTMAWVPAESAVEELMPRLLPVEPCDLTEGFDPSVPPRTPQEYLRIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFT

SEQ ID NO: 34347 - protein, 220 aa, Homo sapiens
  Payload ID: 6784
  Gene Symbol: GEMIN2
  Gene Name: gem (nuclear organelle) associated protein 2
  ENSP ID: ENSP00000436065
  MOD_RES (1)..(1): Any amino acid
XAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQGRWLYALLACLEKPLLPEAHSLIRQLARRCSEVRLLV

SEQ ID NO: 34348 - protein, 149 aa, Homo sapiens
  Payload ID: 6784
  Gene Symbol: GEMIN2
  Gene Name: gem (nuclear organelle) associated protein 2
  ENSP ID: ENSP00000436854
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMRWGFAMLARLVLNS

SEQ ID NO: 34349 - protein, 22 aa, Homo sapiens
  Payload ID: 6784
  Gene Symbol: GEMIN2
  Gene Name: gem (nuclear organelle) associated protein 2
  ENSP ID: ENSP00000474979
DSKDDERVPALNLLICLVSRYS

SEQ ID NO: 34350 - protein, 1058 aa, Homo sapiens
  Payload ID: 6785
  Gene Symbol: GEMIN4
  Gene Name: gem (nuclear organelle) associated protein 4
  Uniprot ID: P57678
  ENSP ID: ENSP00000321706
MDLGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLDKLATVISVWNSDTQNPYHQQALAEKVKEAERDVSLTSLAKLPSETIFVGCEFLHHLLREWGEELQAVLRSSQGTSYDSYRLCDSLTSFSQNATLYLNRTSLSKEDRQVVSELAECVRDFLRKTSTVLKNRALEDITASIAMAVIQQKMDRHMEVCYIFASEKKWAFSDEWVACLGSNRALFRQPDLVLRLLETVIDVSTADRAIPESQIRQVIHLILECYADLSLPGKNKVLAGILRSWGRKGLSEKLLAYVEGFQEDLNTTFNQLTQSASEQGLAKAVASVARLVIVHPEVTVKKMCSLAVVNLGTHKFLAQILTAFPALRFVEEQGPNSSATFMVSCLKETVWMKFSTPKEEKQFLELLNCLMSPVKPQGIPVAALLEPDEVLKEFVLPFLRLDVEEVDLSLRIFIQTLEANACREEYWLQTCSPFPLLFSLCQLLDRFSKYWQLPKEKRCLSLDRKDLAIHILELLCEIVSANAETFSPDVWIKSLSWLHRKLEQLDWTVGLRLKSFFEGHFKCEVPATLFEICKLSEDEWTSQAHPGYGAGTGLLAWMECCCVSSGISERMLSLLVVDVGNPEEVRLFSKGFLVALVQVMPWCSPQEWQRLHQLTRRLLEKQLLHVPYSLEYIQFVPLLNLKPFAQELQLSVLFLRTFQFLCSHSCRDWLPLEGWNHVVKLLCGSLTRLLDSVRAIQAAGPWVQGPEQDLTQEALFVYTQVFCHALHIMAMLHPEVCEPLYVLALETLTCYETLSKTNPSVSSLLQRAHEQRFLKSIAEGIGPEERRQTLLQKMSSF

SEQ ID NO: 34351 - protein, 184 aa, Homo sapiens
  Payload ID: 6785
  Gene Symbol: GEMIN4
  Gene Name: gem (nuclear organelle) associated protein 4
  ENSP ID: ENSP00000392460
MDLGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWERTTPRRCLQPCIWTNWPR

SEQ ID NO: 34352 - protein, 70 aa, Homo sapiens
  Payload ID: 6785
  Gene Symbol: GEMIN4
  Gene Name: gem (nuclear organelle) associated protein 4
  ENSP ID: ENSP00000458896
MFEACSQGPLNICEEMTILHGGFLLAEQLFHPKALAELTKSDWERVGRPIVEALREISSAAAHSQPFAWK

SEQ ID NO: 34353 - protein, 1047 aa, Homo sapiens
  Payload ID: 6785
  Gene Symbol: GEMIN4
  Gene Name: gem (nuclear organelle) associated protein 4
  ENSP ID: ENSP00000459565
MTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLDKLATVISVWNSDTQNPYHQQALAEKVKEAERDVSLTSLAKLPSETIFVGCEFLHHLLREWGEELQAVLRSSQGTSYDSYRLCDSLTSFSQNATLYLNRTSLSKEDRQVVSELAECVRDFLRKTSTVLKNRALEDITASIAMAVIQQKMDRHMEVCYIFASEKKWAFSDEWVACLGSNRALFRQPDLVLRLLETVIDVSTADRAIPESQIRQVIHLILECYADLSLPGKNKVLAGILRSWGRKGLSEKLLAYVEGFQEDLNTTFNQLTQSASEQGLAKAVASVARLVIVHPEVTVKKMCSLAVVNLGTHKFLAQILTAFPALRFVEEQGPNSSATFMVSCLKETVWMKFSTPKEEKQFLELLNCLMSPVKPQGIPVAALLEPDEVLKEFVLPFLRLDVEEVDLSLRIFIQTLEANACREEYWLQTCSPFPLLFSLCQLLDRFSKYWQLPKEKRCLSLDRKDLAIHILELLCEIVSANAETFSPDVWIKSLSWLHRKLEQLDWTVGLRLKSFFEGHFKCEVPATLFEICKLSEDEWTSQAHPGYGAGTGLLAWMECCCVSSGISERMLSLLVVDVGNPEEVRLFSKGFLVALVQVMPWCSPQEWQRLHQLTRRLLEKQLLHVPYSLEYIQFVPLLNLKPFAQELQLSVLFLRTFQFLCSHSCRDWLPLEGWNHVVKLLCGSLTRLLDSVRAIQAAGPWVQGPEQDLTQEALFVYTQVFCHALHIMAMLHPEVCEPLYVLALETLTCYETLSKTNPSVSSLLQRAHEQRFLKSIAEGIGPEERRQTLLQKMSSF

SEQ ID NO: 34354 - protein, 296 aa, Homo sapiens
  Payload ID: 6785
  Gene Symbol: GEMIN4
  Gene Name: gem (nuclear organelle) associated protein 4
  ENSP ID: ENSP00000460286
MFEACSQGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLDKLATVISVWNSDTQNPYHQQALAEK

SEQ ID NO: 34355 - protein, 271 aa, Homo sapiens
  Payload ID: 6785
  Gene Symbol: GEMIN4
  Gene Name: gem (nuclear organelle) associated protein 4
  ENSP ID: ENSP00000461103
MFEACSQGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLD

SEQ ID NO: 34356 - protein, 189 aa, Homo sapiens
  Payload ID: 6785
  Gene Symbol: GEMIN4
  Gene Name: gem (nuclear organelle) associated protein 4
  ENSP ID: ENSP00000461368
MTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPP

SEQ ID NO: 34357 - protein, 1508 aa, Homo sapiens
  Payload ID: 6786
  Gene Symbol: GEMIN5
  Gene Name: gem (nuclear organelle) associated protein 5
  Uniprot ID: Q8TEQ6
  ENSP ID: ENSP00000285873
MGQEPRTLPPSPNWYCARCSDAVPGGLFGFAARTSVFLVRVGPGAGESPGTPPFRVIGELVGHTERVSGFTFSHHPGQYNLCATSSDDGTVKIWDVETKTVVTEHALHQHTISTLHWSPRVKDLIVSGDEKGVVFCYWFNRNDSQHLFIEPRTIFCLTCSPHHEDLVAIGYKDGIVVIIDISKKGEVIHRLRGHDDEIHSIAWCPLPGEDCLSINQEETSEEAEITNGNAVAQAPVTKGCYLATGSKDQTIRIWSCSRGRGVMILKLPFLKRRGGGIDPTVKERLWLTLHWPSNQPTQLVSSCFGGELLQWDLTQSWRRKYTLFSASSEGQNHSRIVFNLCPLQTEDDKQLLLSTSMDRDVKCWDIATLECSWTLPSLGGFAYSLAFSSVDIGSLAIGVGDGMIRVWNTLSIKNNYDVKNFWQGVKSKVTALCWHPTKEGCLAFGTDDGKVGLYDTYSNKPPQISSTYHKKTVYTLAWGPPVPPMSLGGEGDRPSLALYSCGGEGIVLQHNPWKLSGEAFDINKLIRDTNSIKYKLPVHTEISWKADGKIMALGNEDGSIEIFQIPNLKLICTIQQHHKLVNTISWHHEHGSQPELSYLMASGSNNAVIYVHNLKTVIESSPESPVTITEPYRTLSGHTAKITSVAWSPHHDGRLVSASYDGTAQVWDALREEPLCNFRGHRGRLLCVAWSPLDPDCIYSGADDFCVHKWLTSMQDHSRPPQGKKSIELEKKRLSQPKAKPKKKKKPTLRTPVKLESIDGNEEESMKENSGPVENGVSDQEGEEQAREPELPCGLAPAVSREPVICTPVSSGFEKSKVTINNKVILLKKEPPKEKPETLIKKRKARSLLPLSTSLDHRSKEELHQDCLVLATAKHSRELNEDVSADVEERFHLGLFTDRATLYRMIDIEGKGHLENGHPELFHQLMLWKGDLKGVLQTAAERGELTDNLVAMAPAAGYHVWLWAVEAFAKQLCFQDQYVKAASHLLSIHKVYEAVELLKSNHFYREAIAIAKARLRPEDPVLKDLYLSWGTVLERDGHYAVAAKCYLGATCAYDAAKVLAKKGDAASLRTAAELAAIVGEDELSASLALRCAQELLLANNWVGAQEALQLHESLQGQRLVFCLLELLSRHLEEKQLSEGKSSSSYHTWNTGTEGPFVERVTAVWKSIFSLDTPEQYQEAFQKLQNIKYPSATNNTPAKQLLLHICHDLTLAVLSQQMASWDEAVQALLRAVVRSYDSGSFTIMQEVYSAFLPDGCDHLRDKLGDHQSPATPAFKSLEAFFLYGRLYEFWWSLSRPCPNSSVWVRAGHRTLSVEPSQQLDTASTEETDPETSQPEPNRPSELDLRLTEEGERMLSTFKELFSEKHASLQNSQRTVAEVQETLAEMIRQHQKSQLCKSTANGPDKNEPEVEAEQPLCSSQSQCKEEKNEPLSLPELTKRLTEANQRMAKFPESIKAWPFPDVLECCLVLLLIRSHFPGCLAQEMQQQAQELLQKYGNTKTYRRHCQTFCM

SEQ ID NO: 34358 - protein, 167 aa, Homo sapiens
  Payload ID: 6787
  Gene Symbol: GEMIN6
  Gene Name: gem (nuclear organelle) associated protein 6
  Uniprot ID: Q8WXD5
  ENSP ID: ENSP00000281950
MSEWMKKGPLEWQDYIYKEVRVTASEKNEYKGWVLTTDPVSANIVLVNFLEDGSMSVTGIMGHAVQTVETMNEGDHRVREKLMHLFTSGDCKAYSPEDLEERKNSLKKWLEKNHIPITEQGDAPRTLCVAGVLTIDPPYGPENCSSSNEIILSRVQDLIEGHLTASQ

SEQ ID NO: 34359 - protein, 111 aa, Homo sapiens
  Payload ID: 6787
  Gene Symbol: GEMIN6
  Gene Name: gem (nuclear organelle) associated protein 6
  ENSP ID: ENSP00000386613
MSEWMKKGPLEWQDYIYKEVRVTASEKNEYKGWVLTTDPVSAKVLLSPRLECSGEISALCNLHLAGSSDSPALASRVAGTTGICHHVWLIFVFFVETGLRHVAQYCPCELP

SEQ ID NO: 34360 - protein, 69 aa, Homo sapiens
  Payload ID: 6787
  Gene Symbol: GEMIN6
  Gene Name: gem (nuclear organelle) associated protein 6
  ENSP ID: ENSP00000387191
MSEWMKKGPLEWQDYIYKEVRVTASEKNEYKGWVLTTDPVSAKVLLSPRLECSGEISALCNLHLAVLSL

SEQ ID NO: 34361 - protein, 131 aa, Homo sapiens
  Payload ID: 6788
  Gene Symbol: GEMIN7
  Gene Name: gem (nuclear organelle) associated protein 7
  Uniprot ID: Q9H840
  ENSP ID: ENSP00000270257
MQTPVNIPVPVLRLPRGPDGFSRGFAPDGRRAPLRPEVPEIQECPIAQESLESQEQRARAALRERYLRSLLAMVGHQVSFTLHEGVRVAAHFGATDLDVANFYVSQLQTPIGVQAEALLRCSDIISYTFKP

SEQ ID NO: 34362 - protein, 131 aa, Homo sapiens; identical to SEQ ID NO: 34361
  Payload ID: 6788
  Gene Symbol: GEMIN7
  Gene Name: gem (nuclear organelle) associated protein 7
  Uniprot ID: Q9H840
  ENSP ID: ENSP00000375813

SEQ ID NO: 34363 - protein, 131 aa, Homo sapiens; identical to SEQ ID NO: 34361
  Payload ID: 6788
  Gene Symbol: GEMIN7
  Gene Name: gem (nuclear organelle) associated protein 7
  Uniprot ID: Q9H840
  ENSP ID: ENSP00000465704

SEQ ID NO: 34364 - protein, 131 aa, Homo sapiens; identical to SEQ ID NO: 34361
  Payload ID: 6788
  Gene Symbol: GEMIN7
  Gene Name: gem (nuclear organelle) associated protein 7
  Uniprot ID: Q9H840
  ENSP ID: ENSP00000466342

SEQ ID NO: 34365 - protein, 177 aa, Homo sapiens
  Payload ID: 6789
  Gene Symbol: GEMIN8
  Gene Name: gem (nuclear organelle) associated protein 8
  ENSP ID: ENSP00000369894
MAAVKASTSKATRPWYSHPVYARYWQHYHQAMAWMQSHHNAYRKAVESCFNLPWYLPSALLPQSSYDNEAAYPQSFYDHHVAWQDYPCSSSHFRRSGQHPRYSSRIQASTKEDQALSKEEEMETESDAEVECDLSNMEITEELRQYFAETERHREERRRQQQLDAERLDSYVNADHD

SEQ ID NO: 34366 - protein, 242 aa, Homo sapiens
  Payload ID: 6789
  Gene Symbol: GEMIN8
  Gene Name: gem (nuclear organelle) associated protein 8
  Uniprot ID: Q9NWZ8
  ENSP ID: ENSP00000369895
MAAVKASTSKATRPWYSHPVYARYWQHYHQAMAWMQSHHNAYRKAVESCFNLPWYLPSALLPQSSYDNEAAYPQSFYDHHVAWQDYPCSSSHFRRSGQHPRYSSRIQASTKEDQALSKEEEMETESDAEVECDLSNMEITEELRQYFAETERHREERRRQQQLDAERLDSYVNADHDLYCNTRRSVEAPTERPGERRQAEMKRLYGDSAAKIQAMEAAVQLSFDKHCDRKQPKYWPVIPLKF

SEQ ID NO: 34367 - protein, 242 aa, Homo sapiens; identical to SEQ ID NO: 34366
  Payload ID: 6789
  Gene Symbol: GEMIN8
  Gene Name: gem (nuclear organelle) associated protein 8
  Uniprot ID: Q9NWZ8
  ENSP ID: ENSP00000381398

SEQ ID NO: 34368 - protein, 970 aa, Homo sapiens
  Payload ID: 6790
  Gene Symbol: GMIP
  Gene Name: GEM interacting protein
  Uniprot ID: Q9P107
  ENSP ID: ENSP00000203556
MDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 34369 - protein, 303 aa, Homo sapiens
  Payload ID: 6790
  Gene Symbol: GMIP
  Gene Name: GEM interacting protein
  ENSP ID: ENSP00000465108
  MOD_RES (1)..(1): Any amino acid
XRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRD

SEQ ID NO: 34370 - protein, 36 aa, Homo sapiens
  Payload ID: 6790
  Gene Symbol: GMIP
  Gene Name: GEM interacting protein
  ENSP ID: ENSP00000466045
MDAAEPGLPPGPEGRKRYSDIFRSLDNLEISLGNDP

SEQ ID NO: 34371 - protein, 944 aa, Homo sapiens
  Payload ID: 6790
  Gene Symbol: GMIP
  Gene Name: GEM interacting protein
  Uniprot ID: Q9P107
  ENSP ID: ENSP00000467054
MDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 34372 - protein, 94 aa, Homo sapiens
  Payload ID: 6790
  Gene Symbol: GMIP
  Gene Name: GEM interacting protein
  ENSP ID: ENSP00000467946
MLAGDPLLSEDPEPDKTPTATVTNEASCWSGPSPEGPVPLTGEELDLRLIRTKGGVDAALEYAKTWSRYAKELLAWTEKRASYELEFAKSTMKI

SEQ ID NO: 34373 - protein, 36 aa, Homo sapiens; identical to SEQ ID NO: 34370
  Payload ID: 6790
  Gene Symbol: GMIP
  Gene Name: GEM interacting protein
  ENSP ID: ENSP00000468662

SEQ ID NO: 34374 - protein, 63 aa, Homo sapiens
  Payload ID: 6791
  Gene Symbol: GMNC
  Gene Name: geminin coiled-coil domain containing
  ENSP ID: ENSP00000396337
MNTILPCQDQYFVGGQSYNCPYSTTTSESSVDVSTETWVSFWAAGLLDNRELQQAPQAQVSTI

SEQ ID NO: 34375 - protein, 334 aa, Homo sapiens
  Payload ID: 6791
  Gene Symbol: GMNC
  Gene Name: geminin coiled-coil domain containing
  Uniprot ID: A6NCL1
  ENSP ID: ENSP00000406164
MNTILPCQDQYFVGGQSYNCPYSTTTSESSVDVSTETWVSFWAAGLLDNRELQQAPQAQESFSDSNFPLPDLCSWEEAQLSSQLYRNKQLQDTLVQKEEELARLHEENNHLRQYLNSALVKCLEEKAKKLLSSDEFSKAYGKFRKGKRKSKEQRYSPAEIPHPKNAKRNLSSEFANCEEQAGPPVDPWVLQTLGLKDLDTIDDTSSANYSALASHPRRVASTFSQFPDDAVDYKNIPREDMPIDYRGDRTTPLHSTATHGEDFHILSQLSNPPVGLKTLPYYTAHVSPNKTEMAFSTSLSPHCNVKTHSFHQGQAFVRRDEEGGWKFTWVPKQS

SEQ ID NO: 34376 - protein, 209 aa, Homo sapiens
  Payload ID: 6792
  Gene Symbol: GMNN
  Gene Name: geminin, DNA replication inhibitor
  Uniprot ID: O75496
  ENSP ID: ENSP00000230056
MNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKLHKEIEQKDNEIARLKKENKELAEVAEHVQYMAELIERLNGEPLDNFESLDNQEFDSEEETVEDSLVEDSEIGTCAEGTVSSSTDAKPCI

SEQ ID NO: 34377 - protein, 209 aa, Homo sapiens; identical to SEQ ID NO: 34376
  Payload ID: 6792
  Gene Symbol: GMNN
  Gene Name: geminin, DNA replication inhibitor
  Uniprot ID: O75496
  ENSP ID: ENSP00000348902

SEQ ID NO: 34378 - protein, 179 aa, Homo sapiens
  Payload ID: 6792
  Gene Symbol: GMNN
  Gene Name: geminin, DNA replication inhibitor
  ENSP ID: ENSP00000367293
MNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKLHKEIEQKDNEIARLKKENKELAEVAEHVQYMAELIERLNGEPLDNFESLDNQEFDSEEE

SEQ ID NO: 34379 - protein, 102 aa, Homo sapiens
  Payload ID: 6792
  Gene Symbol: GMNN
  Gene Name: geminin, DNA replication inhibitor
  ENSP ID: ENSP00000367298
MNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEV

SEQ ID NO: 34380 - protein, 65 aa, Homo sapiens
  Payload ID: 6792
  Gene Symbol: GMNN
  Gene Name: geminin, DNA replication inhibitor
  ENSP ID: ENSP00000419584
MNPSMKQKQEEIKENIKNSSVPRRTLKMIQPSASGSLVGRENELSAGLSKRKHRNDHLTSTTSSP

SEQ ID NO: 34381 - protein, 209 aa, Homo sapiens; identical to SEQ ID NO: 34376
  Payload ID: 6792
  Gene Symbol: GMNN
  Gene Name: geminin, DNA replication inhibitor
  Uniprot ID: O75496
  ENSP ID: ENSP00000477506

SEQ ID NO: 34382 - protein, 908 aa, Homo sapiens
  Payload ID: 6793
  Gene Symbol: GEN1
  Gene Name: GEN1 Holliday junction 5' flap endonuclease
  Uniprot ID: Q17RS7
  ENSP ID: ENSP00000318977
MGVNDLWQILEPVKQHIPLRNLGGKTIAVDLSLWVCEAQTVKKMMGSVMKPHLRNLFFRISYLTQMDVKLVFVMEGEPPKLKADVISKRNQSRYGSSGKSWSQKTGRSHFKSVLRECLHMLECLGIPWVQAAGEAEAMCAYLNAGGHVDGCLTNDGDTFLYGAQTVYRNFTMNTKDPHVDCYTMSSIKSKLGLDRDALVGLAILLGCDYLPKGVPGVGKEQALKLIQILKGQSLLQRFNRWNETSCNSSPQLLVTKKLAHCSVCSHPGSPKDHERNGCRLCKSDKYCEPHDYEYCCPCEWHRTEHDRQLSEVENNIKKKACCCEGFPFHEVIQEFLLNKDKLVKVIRYQRPDLLLFQRFTLEKMEWPNHYACEKLLVLLTHYDMIERKLGSRNSNQLQPIRIVKTRIRNGVHCFEIEWEKPEHYAMEDKQHGEFALLTIEEESLFEAAYPEIVAVYQKQKLEIKGKKQKRIKPKENNLPEPDEVMSFQSHMTLKPTCEIFHKQNSKLNSGISPDPTLPQESISASLNSLLLPKNTPCLNAQEQFMSSLRPLAIQQIKAVSKSLISESSQPNTSSHNISVIADLHLSTIDWEGTSFSNSPAIQRNTFSHDLKSEVESELSAIPDGFENIPEQLSCESERYTANIKKVLDEDSDGISPEEHLLSGITDLCLQDLPLKERIFTKLSYPQDNLQPDVNLKTLSILSVKESCIANSGSDCTSHLSKDLPGIPLQNESRDSKILKGDQLLQEDYKVNTSVPYSVSNTVVKTCNVRPPNTALDHSRKVDMQTTRKILMKKSVCLDRHSSDEQSAPVFGKAKYTTQRMKHSSQKHNSSHFKESGHNKLSSPKIHIKETEQCVRSYETAENEESCFPDSTKSSLSSLQCHKKENNSGTCLDSPLPLRQRLKLRFQST

SEQ ID NO: 34383 - protein, 908 aa, Homo sapiens; identical to SEQ ID NO: 34382
  Payload ID: 6793
  Gene Symbol: GEN1
  Gene Name: GEN1 Holliday junction 5' flap endonuclease
  Uniprot ID: Q17RS7
  ENSP ID: ENSP00000370653

SEQ ID NO: 34384 - protein, 93 aa, Homo sapiens
  Payload ID: 6793
  Gene Symbol: GEN1
  Gene Name: GEN1 Holliday junction 5' flap endonuclease
  ENSP ID: ENSP00000433180
MGVNDLWQILEPVKQHIPLRNLGGKTIAVDLSLWVCEAQTVKKMMGSVMKPHLRNLFFRISYLTQMDVKLVFVMEGEPPKLKADVISKRNQSR

SEQ ID NO: 34385 - protein, 126 aa, Homo sapiens
  Payload ID: 6793
  Gene Symbol: GEN1
  Gene Name: GEN1 Holliday junction 5' flap endonuclease
  ENSP ID: ENSP00000435143
MGVNDLWQILEPVKQHIPLRNLGGKTIAVDLSLWVCEAQTVKKMMGSVMKPHLRNLFFRISYLTQMDVKLVFVMEGEPPKLKADVISKRNQSRYGSSGKSWSQKTGRSHFKSVLRECLHMLECLGI

SEQ ID NO: 34386 - protein, 129 aa, Homo sapiens
  Payload ID: 6793
  Gene Symbol: GEN1
  Gene Name: GEN1 Holliday junction 5' flap endonuclease
  ENSP ID: ENSP00000481385
HERNGCRLCKSDKYCEPHDYEYCCPCEWHRTEHDRQLSEVENNIKKKACCCEGFPFHEVIQEFLLNKDKLVKVIRYQRPDLLLFQRFTLEKMEWPNHYACEKLLVLLTHYDMIERKLGSRNSNQLQPIR

SEQ ID NO: 34387 - protein, 59 aa, Homo sapiens
  Payload ID: 6794
  Gene Symbol: GTF2A1
  Gene Name: general transcription factor IIA, 1, 19/37kDa
  ENSP ID: ENSP00000298173
MANSANTNTVPKLYRSVIEDVINDVRDIFLDDGVDEQVLMELKTILNKTVAAQKMFILW

SEQ ID NO: 34388 - protein, 337 aa, Homo sapiens
  Payload ID: 6794
  Gene Symbol: GTF2A1
  Gene Name: general transcription factor IIA, 1, 19/37kDa
  Uniprot ID: P52655
  ENSP ID: ENSP00000409492
MELKTLWENKLMQSRAVDGFHSEEQQLLLQVQQQHQPQQQQHHHHHHHQQAQPQQTVPQQAQTQQVLIPASQQATAPQVIVPDSKLIQHMNASNMSAAATAATLALPAGVTPVQQILTNSGQLLQVVRAANGAQYIFQPQQSVVLQQQVIPQMQPGGVQAPVIQQVLAPLPGGISPQTGVIIQPQQILFTGNKTQVIPTTVAAPTPAQAQITATGQQQPQAQPAQTQAPLVLQVDGTGDTSSEEDEDEEEDYDDDEEEDKEKDGAEDGQVEEEPLNSEDDVSDEEGQELFDTENVVVCQYDKIHRSKNKWKFHLKDGIMNLNGRDYIFSKAIGDAEW

SEQ ID NO: 34389 - protein, 376 aa, Homo sapiens
  Payload ID: 6794
  Gene Symbol: GTF2A1
  Gene Name: general transcription factor IIA, 1, 19/37kDa
  Uniprot ID: P52655
  ENSP ID: ENSP00000452454
MANSANTNTVPKLYRSVIEDVINDVRDIFLDDGVDEQVLMELKTLWENKLMQSRAVDGFHSEEQQLLLQVQQQHQPQQQQHHHHHHHQQAQPQQTVPQQAQTQQVLIPASQQATAPQVIVPDSKLIQHMNASNMSAAATAATLALPAGVTPVQQILTNSGQLLQVVRAANGAQYIFQPQQSVVLQQQVIPQMQPGGVQAPVIQQVLAPLPGGISPQTGVIIQPQQILFTGNKTQVIPTTVAAPTPAQAQITATGQQQPQAQPAQTQAPLVLQVDGTGDTSSEEDEDEEEDYDDDEEEDKEKDGAEDGQVEEEPLNSEDDVSDEEGQELFDTENVVVCQYDKIHRSKNKWKFHLKDGIMNLNGRDYIFSKAIGDAEW

SEQ ID NO: 34390 - protein, 478 aa, Homo sapiens
  Payload ID: 6795
  Gene Symbol: GTF2A1L
  Gene Name: general transcription factor IIA, 1-like
  Uniprot ID: Q9UNN4
  ENSP ID: ENSP00000384597
MACLNPVPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 34391 - protein, 444 aa, Homo sapiens
  Payload ID: 6795
  Gene Symbol: GTF2A1L
  Gene Name: general transcription factor IIA, 1-like
  Uniprot ID: Q9UNN4
  ENSP ID: ENSP00000387896
MACLNPVLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 34392 - protein, 55 aa, Homo sapiens
  Payload ID: 6795
  Gene Symbol: GTF2A1L
  Gene Name: general transcription factor IIA, 1-like
  ENSP ID: ENSP00000394793
MACLNPVLWETKVLQSKATEDFFRNSIQSPLFTLQLPHSLHQTLQSSTGWIPLHH

SEQ ID NO: 34393 - protein, 335 aa, Homo sapiens
  Payload ID: 6795
  Gene Symbol: GTF2A1L
  Gene Name: general transcription factor IIA, 1-like
  ENSP ID: ENSP00000396702
MACLNPVPKLYRSVIEDVIEGVRNLFAEEGIEEQVLKDLKQLWETKVLQSKATEDFFRNSIQSPLFTLQLPHSLHQTLQSSTGWIPLVNEYSSLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEK

SEQ ID NO: 34394 - protein, 164 aa, Homo sapiens
  Payload ID: 6795
  Gene Symbol: GTF2A1L
  Gene Name: general transcription factor IIA, 1-like
  ENSP ID: ENSP00000412645
MACLNPVLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPA

SEQ ID NO: 34395 - protein, 102 aa, Homo sapiens
  Payload ID: 6795
  Gene Symbol: GTF2A1L
  Gene Name: general transcription factor IIA, 1-like
  ENSP ID: ENSP00000421474
SGDTSSNEEIGSTRDADENEFLGNIDGGDLKVPEEEADSISNEDSATNSSDNEDPQVNIVEEDPLNSGDDVSEQDVPDLFDTDNVIVCQYDKAFPRRTSFNT

SEQ ID NO: 34396 - protein, 109 aa, Homo sapiens
  Payload ID: 6796
  Gene Symbol: GTF2A2
  Gene Name: general transcription factor IIA, 2, 12kDa
  Uniprot ID: P52657
  ENSP ID: ENSP00000379372
MAYQLYRNTTLGNSLQESLDELIQSQQITPQLALQVLLQFDKAINAALAQRVRNRVNFRGSLNTYRFCDNVWTFVLNDVEFREVTELIKVDKVKIVACDGKNTGSNTTE

SEQ ID NO: 34397 - protein, 109 aa, Homo sapiens; identical to SEQ ID NO: 34396
  Payload ID: 6796
  Gene Symbol: GTF2A2
  Gene Name: general transcription factor IIA, 2, 12kDa
  Uniprot ID: P52657
  ENSP ID: ENSP00000379373

SEQ ID NO: 34398 - protein, 109 aa, Homo sapiens; identical to SEQ ID NO: 34396
  Payload ID: 6796
  Gene Symbol: GTF2A2
  Gene Name: general transcription factor IIA, 2, 12kDa
  Uniprot ID: P52657
  ENSP ID: ENSP00000379375

SEQ ID NO: 34399 - protein, 68 aa, Homo sapiens
  Payload ID: 6796
  Gene Symbol: GTF2A2
  Gene Name: general transcription factor IIA, 2, 12kDa
  ENSP ID: ENSP00000379376
MAYQLYRNTTLGNSLQESLDELIQSQQITPQLALQVLLQFDKAINAALAQRVRNRVNFRILAPILQNE

SEQ ID NO: 34400 - protein, 74 aa, Homo sapiens
  Payload ID: 6796
  Gene Symbol: GTF2A2
  Gene Name: general transcription factor IIA, 2, 12kDa
  ENSP ID: ENSP00000418574
MAYQLYRNTTLGNSLQESLDELIQGSLNTYRFCDNVWTFVLNDVEFREVTELIKVDKVKIVACDGKNTGSNTTE

SEQ ID NO: 34401 - protein, 72 aa, Homo sapiens
  Payload ID: 6796
  Gene Symbol: GTF2A2
  Gene Name: general transcription factor IIA, 2, 12kDa
  ENSP ID: ENSP00000452648
MAYQLYRNTTLGNSLQESLDELIQITPQLALQVLLQFDKAINAALAQRVRNRVNFRGSLNTYRFCDNVWTFV

SEQ ID NO: 34402 - protein, 316 aa, Homo sapiens
  Payload ID: 6797
  Gene Symbol: GTF2B
  Gene Name: general transcription factor IIB
  Uniprot ID: Q00403
  ENSP ID: ENSP00000359531
MASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKEIGDIAGVADVTIRQSYRLIYPRAPDLFPTDFKFDTPVDKLPQL

SEQ ID NO: 34403 - protein, 231 aa, Homo sapiens
  Payload ID: 6797
  Gene Symbol: GTF2B
  Gene Name: general transcription factor IIB
  ENSP ID: ENSP00000402345
MASTSRLDALPRVTCPNHPDAILVEDYRAGDMICPECDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIA

SEQ ID NO: 34404 - protein, 224 aa, Homo sapiens
  Payload ID: 6797
  Gene Symbol: GTF2B
  Gene Name: general transcription factor IIB
  ENSP ID: ENSP00000415741
ASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRNWRYCWCC

SEQ ID NO: 34405 - protein, 439 aa, Homo sapiens
  Payload ID: 6798
  Gene Symbol: GTF2E1
  Gene Name: general transcription factor IIE, polypeptide 1, alpha 56kDa
  Uniprot ID: P29083
  ENSP ID: ENSP00000283875
MADPDVLTEVPAALKRLAKYVIRGFYGIEHALALDILIRNSCVKEEDMLELLKFDRKQLRSVLNNLKGDKFIKCRMRVETAADGKTTRHNYYFINYRTLVNVVKYKLDHMRRRIETDERDSTNRASFKCPVCSSTFTDLEANQLFDPMTGTFRCTFCHTEVEEDESAMPKKDARTLLARFNEQIEPIYALLRETEDVNLAYEILEPEPTEIPALKQSKDHAATTAGAASLAGGHHREAWATKGPSYEDLYTQNVVINMDDQEDLHRASLEGKSAKERPIWLRESTVQGAYGSEDMKEGGIDMDAFQEREEGHAGPDDNEEVMRALLIHEKKTSSAMAGSVGAAAPVTAANGSDSESETSESDDDSPPRPAAVAVHKREEDEEEDDEFEEVADDPIVMVAGRPFSYSEVSQRPELVAQMTPEEKEAYIAMGQRMFEDLFE

SEQ ID NO: 34406 - protein, 122 aa, Homo sapiens
  Payload ID: 6798
  Gene Symbol: GTF2E1
  Gene Name: general transcription factor IIE, polypeptide 1, alpha 56kDa
  ENSP ID: ENSP00000417077
MADPDVLTEVPAALKRLAKYVIRGFYGIEHALALDILIRNSCVKEEDMLELLKFDRKQLRSVLNNLKGDKFIKCRMRVETAADGKTTRHNYYFINYRTLVNVVKYKLDHMRRRIETDERDST

SEQ ID NO: 34407 - protein, 49 aa, Homo sapiens
  Payload ID: 6798
  Gene Symbol: GTF2E1
  Gene Name: general transcription factor IIE, polypeptide 1, alpha 56kDa
  ENSP ID: ENSP00000417342
MADPDVLTEVPAALKRLAKYVIRGFYGIEHALALDILIRNSCVKEEDML

SEQ ID NO: 34408 - protein, 129 aa, Homo sapiens
  Payload ID: 6798
  Gene Symbol: GTF2E1
  Gene Name: general transcription factor IIE, polypeptide 1, alpha 56kDa
  ENSP ID: ENSP00000418808
MPKKDARTLLARFNEQIEPIYALLRETEDVNLAYEILEPEPTEIPALKQSKDHAATTAGAASLAGGHHREAWATKGPSYEDLYTQNVVINMDDQEDLHRASLEGKSAKERPIWLRESTVQGAYGSEDMK

SEQ ID NO: 34409 - protein, 291 aa, Homo sapiens
  Payload ID: 6799
  Gene Symbol: GTF2E2
  Gene Name: general transcription factor IIE, polypeptide 2, beta 34kDa
  Uniprot ID: P29084
  ENSP ID: ENSP00000348168
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKKKILFFNDKSCQFSVDEEFQKLWRSVTVDSMDEEKIEEYLKRQGISSMQESGPKKVAPIQRRKKPASQKKRRFKTHNEHLAGVLKDYSDITSSK

SEQ ID NO: 34410 - protein, 73 aa, Homo sapiens
  Payload ID: 6799
  Gene Symbol: GTF2E2
  Gene Name: general transcription factor IIE, polypeptide 2, beta 34kDa
  ENSP ID: ENSP00000428981
MDPSLLRERELFKKRALSTPVVEKRSASSESSSSSSKKKKTKVEHGGSSGSKQNSVFPVVYTVAWDVLNTLGE

SEQ ID NO: 34411 - protein, 126 aa, Homo sapiens
  Payload ID: 6799
  Gene Symbol: GTF2E2
  Gene Name: general transcription factor IIE, polypeptide 2, beta 34kDa
  ENSP ID: ENSP00000429312
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVN

SEQ ID NO: 34412 - protein, 198 aa, Homo sapiens
  Payload ID: 6799
  Gene Symbol: GTF2E2
  Gene Name: general transcription factor IIE, polypeptide 2, beta 34kDa
  ENSP ID: ENSP00000429921
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKK

SEQ ID NO: 34413 - protein, 517 aa, Homo sapiens
  Payload ID: 6800
  Gene Symbol: GTF2F1
  Gene Name: general transcription factor IIF, polypeptide 1, 74kDa
  Uniprot ID: P35269
  ENSP ID: ENSP00000377969
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSALFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 34414 - protein, 433 aa, Homo sapiens
  Payload ID: 6800
  Gene Symbol: GTF2F1
  Gene Name: general transcription factor IIF, polypeptide 1, 74kDa
  ENSP ID: ENSP00000469091
IMAFNAADKVNFATWNQARLERDLSNKKIYQEEEMPESGAGSEFNRKLREEARRKKYGIVLKEFRPEDQPWLLRVNGKSGRKRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSALFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 34415 - protein, 381 aa, Homo sapiens
  Payload ID: 6800
  Gene Symbol: GTF2F1
  Gene Name: general transcription factor IIF, polypeptide 1, 74kDa
  ENSP ID: ENSP00000471403
MSLNTSFEFLRNTPCLSSLLPKAEFTIISTSWVPPNLRPSICSSSAWGQERMGLASLADWESLESSVSSVARQNRLNEAGNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDK

SEQ ID NO: 34416 - protein, 127 aa, Homo sapiens
  Payload ID: 6800
  Gene Symbol: GTF2F1
  Gene Name: general transcription factor IIF, polypeptide 1, 74kDa
  ENSP ID: ENSP00000471542
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIF

SEQ ID NO: 34417 - protein, 249 aa, Homo sapiens
  Payload ID: 6801
  Gene Symbol: GTF2F2
  Gene Name: general transcription factor IIF, polypeptide 2, 30kDa
  Uniprot ID: P13984
  ENSP ID: ENSP00000340823
MAERGELDLTGAKQNTGVWLVKVPKYLSQQWAKASGRGEVGKLRIAKTQGRTEVSFTLNEDLANIHDIGGKPASVSAPREHPFVLQSVGGQTLTVFTESSSDKLSLEGIVVQRAECRPAASENYMRLKRLQIEESSKPVRLSQQLDKVVTTNYKPVANHQYNIEYERKKKEDGKRARADKQHVLDMLFSAFEKHQYYNLKDLVDITKQPVVYLKEILKEIGVQNVKGIHKNTWELKPEYRHYQGEEKSD

SEQ ID NO: 34418 - protein, 548 aa, Homo sapiens
  Payload ID: 6802
  Gene Symbol: GTF2H1
  Gene Name: general transcription factor IIH, polypeptide 1, 62kDa
  Uniprot ID: P32780
  ENSP ID: ENSP00000265963
MATSSEEVLLIVKKVRQKKQDGALYLMAERIAWAPEGKDRFTISHMYADIKCQKISPEGKAKIQLQLVLHAGDTTNFHFSNESTAVKERDAVKDLLQQLLPKFKRKANKELEEKNRMLQEDPVLFQLYKDLVVSQVISAEEFWANRLNVNATDSSSTSNHKQDVGISAAFLADVRPQTDGCNGLRYNLTSDIIESIFRTYPAVKMKYAENVPHNMTEKEFWTRFFQSHYFHRDRLNTGSKDLFAECAKIDEKGLKTMVSLGVKNPLLDLTALEDKPLDEGYGISSVPSASNSKSIKENSNAAIIKRFNHHSAMVLAAGLRKQEAQNEQTSEPSNMDGNSGDADCFQPAVKRAKLQESIEYEDLGKNNSVKTIALNLKKSDRYYHGPTPIQSLQYATSQDIINSFQSIRQEMEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 34419 - protein, 548 aa, Homo sapiens; identical to SEQ ID NO: 34418
  Payload ID: 6802
  Gene Symbol: GTF2H1
  Gene Name: general transcription factor IIH, polypeptide 1, 62kDa
  Uniprot ID: P32780
  ENSP ID: ENSP00000393638

SEQ ID NO: 34420 - protein, 95 aa, Homo sapiens
  Payload ID: 6802
  Gene Symbol: GTF2H1
  Gene Name: general transcription factor IIH, polypeptide 1, 62kDa
  ENSP ID: ENSP00000431481
MATSSEEVLLIVKKVRQKKQDGALYLMAERIAWAPEGKDRFTISHMYADIKCQKISPEGKAKIQLQLVLHAGDTTNFHFSNESTAVKERDAVKDL

SEQ ID NO: 34421 - protein, 236 aa, Homo sapiens
  Payload ID: 6802
  Gene Symbol: GTF2H1
  Gene Name: general transcription factor IIH, polypeptide 1, 62kDa
  ENSP ID: ENSP00000433133
MVLAAGLRKQEAQNEQTSEPSNMDGNSGDADCFQPAVKRAKLQESIEYEDLGKNNSVKTIALNLKKSDRYYHGPTPIQSLQYATSQDIINSFQSIRQEMEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 34422 - protein, 432 aa, Homo sapiens
  Payload ID: 6802
  Gene Symbol: GTF2H1
  Gene Name: general transcription factor IIH, polypeptide 1, 62kDa
  Uniprot ID: P32780
  ENSP ID: ENSP00000435375
MLQEDPVLFQLYKDLVVSQVISAEEFWANRLNVNATDSSSTSNHKQDVGISAAFLADVRPQTDGCNGLRYNLTSDIIESIFRTYPAVKMKYAENVPHNMTEKEFWTRFFQSHYFHRDRLNTGSKDLFAECAKIDEKGLKTMVSLGVKNPLLDLTALEDKPLDEGYGISSVPSASNSKSIKENSNAAIIKRFNHHSAMVLAAGLRKQEAQNEQTSEPSNMDGNSGDADCFQPAVKRAKLQESIEYEDLGKNNSVKTIALNLKKSDRYYHGPTPIQSLQYATSQDIINSFQSIRQEMEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 34423 - protein, 181 aa, Homo sapiens
  Payload ID: 6802
  Gene Symbol: GTF2H1
  Gene Name: general transcription factor IIH, polypeptide 1, 62kDa
  ENSP ID: ENSP00000436575
MKYAENVPHNMTEKEFWTRFFQSHYFHRDRLNTGSKDLFAECAKIDEKGLKTMVSLGVKNPLLDLTALEDKPLDEGYGISSVPSASNSKSIKENSNAAIIKRFNHHSAMVLAAGLRKQEAQNEQTSEPSNMDGNSGDADCFQPAVKRVWAKKYEPFGAQVSPNTLCDCKYCIRLFPVTQFF

SEQ ID NO: 34424 - protein, 138 aa, Homo sapiens
  Payload ID: 6802
  Gene Symbol: GTF2H1
  Gene Name: general transcription factor IIH, polypeptide 1, 62kDa
  ENSP ID: ENSP00000439774
MEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 34425 - protein, 395 aa, Homo sapiens
  Payload ID: 6803
  Gene Symbol: GTF2H2
  Gene Name: general transcription factor IIH, polypeptide 2, 44kDa
  Uniprot ID: Q13888
  ENSP ID: ENSP00000274400
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSIAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 34426 - protein, 395 aa, Homo sapiens; identical to SEQ ID NO: 34425
  Payload ID: 6803
  Gene Symbol: GTF2H2
  Gene Name: general transcription factor IIH, polypeptide 2, 44kDa
  Uniprot ID: Q13888
  ENSP ID: ENSP00000328901

SEQ ID NO: 34427 - protein, 51 aa, Homo sapiens
  Payload ID: 6803
  Gene Symbol: GTF2H2
  Gene Name: general transcription factor IIH, polypeptide 2, 44kDa
  ENSP ID: ENSP00000394164
MDEEPERTKRWEGGYERTWEILKEDESGSLKATIEDILFKAKRKRCATFMW

SEQ ID NO: 34428 - protein, 51 aa, Homo sapiens; identical to SEQ ID NO: 34427
  Payload ID: 6803
  Gene Symbol: GTF2H2
  Gene Name: general transcription factor IIH, polypeptide 2, 44kDa
  ENSP ID: ENSP00000428718

SEQ ID NO: 34429 - protein, 123 aa, Homo sapiens
  Payload ID: 6803
  Gene Symbol: GTF2H2
  Gene Name: general transcription factor IIH, polypeptide 2, 44kDa
  ENSP ID: ENSP00000429057
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGV

SEQ ID NO: 34430 - protein, 152 aa, Homo sapiens
  Payload ID: 6803
  Gene Symbol: GTF2H2
  Gene Name: general transcription factor IIH, polypeptide 2, 44kDa
  ENSP ID: ENSP00000473333
  MOD_RES (1)..(1): Any amino acid
XEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSIAMQTLKRGFTVLARMVSIS

SEQ ID NO: 34431 - protein, 23 aa, Homo sapiens
  Payload ID: 6803
  Gene Symbol: GTF2H2
  Gene Name: general transcription factor IIH, polypeptide 2, 44kDa
  ENSP ID: ENSP00000473362
MDEEPERTKRWEGGYERTWEILK

SEQ ID NO: 34432 - protein, 395 aa, Homo sapiens; identical to SEQ ID NO: 34425
  Payload ID: 6803
  Gene Symbol: GTF2H2
  Gene Name: general transcription factor IIH, polypeptide 2, 44kDa
  Uniprot ID: Q13888
  ENSP ID: ENSP00000477954

SEQ ID NO: 34433 - protein, 395 aa, Homo sapiens; identical to SEQ ID NO: 34425
  Payload ID: 6803
  Gene Symbol: GTF2H2
  Gene Name: general transcription factor IIH, polypeptide 2, 44kDa
  Uniprot ID: Q13888
  ENSP ID: ENSP00000479262

SEQ ID NO: 34434 - protein, 4 aa, Homo sapiens
  Payload ID: 6803
  Gene Symbol: GTF2H2
  Gene Name: general transcription factor IIH, polypeptide 2, 44kDa
  ENSP ID: ENSP00000479821
MDEE

SEQ ID NO: 34435 - protein, 51 aa, Homo sapiens; identical to SEQ ID NO: 34427
  Payload ID: 6803
  Gene Symbol: GTF2H2
  Gene Name: general transcription factor IIH, polypeptide 2, 44kDa
  ENSP ID: ENSP00000480417

SEQ ID NO: 34436 - protein, 395 aa, Homo sapiens; identical to SEQ ID NO: 34425
  Payload ID: 6803
  Gene Symbol: GTF2H2
  Gene Name: general transcription factor IIH, polypeptide 2, 44kDa
  Uniprot ID: Q13888
  ENSP ID: ENSP00000480548

SEQ ID NO: 34437 - protein, 3 aa, Homo sapiens
  Payload ID: 6803
  Gene Symbol: GTF2H2
  Gene Name: general transcription factor IIH, polypeptide 2, 44kDa
  ENSP ID: ENSP00000480983
MDE

SEQ ID NO: 34438 - protein, 123 aa, Homo sapiens; identical to SEQ ID NO: 34429
  Payload ID: 6803
  Gene Symbol: GTF2H2
  Gene Name: general transcription factor IIH, polypeptide 2, 44kDa
  ENSP ID: ENSP00000483350

SEQ ID NO: 34439 - protein, 23 aa, Homo sapiens
  Payload ID: 6803
  Gene Symbol: GTF2H2
  Gene Name: general transcription factor IIH, polypeptide 2, 44kDa
  ENSP ID: ENSP00000485816
MDEEPERTKRWEGGYERTWEILK

SEQ ID NO: 34440 - protein, 395 aa, Homo sapiens; identical to SEQ ID NO: 34425
  Payload ID: 6803
  Gene Symbol: GTF2H2
  Gene Name: general transcription factor IIH, polypeptide 2, 44kDa
  Uniprot ID: Q13888
  ENSP ID: ENSP00000486014

SEQ ID NO: 34441 - protein, 123 aa, Homo sapiens; identical to SEQ ID NO: 34429
  Payload ID: 6803
  Gene Symbol: GTF2H2
  Gene Name: general transcription factor IIH, polypeptide 2, 44kDa
  ENSP ID: ENSP00000487055

SEQ ID NO: 34442 - protein, 152 aa, Homo sapiens; identical to SEQ ID NO: 34430
  Payload ID: 6803
  Gene Symbol: GTF2H2
  Gene Name: general transcription factor IIH, polypeptide 2, 44kDa
  ENSP ID: ENSP00000487533
  MOD_RES (1)..(1): Any amino acid

SEQ ID NO: 34443 - protein, 267 aa, Homo sapiens
  Payload ID: 6804
  Gene Symbol: GTF2H3
  Gene Name: general transcription factor IIH, polypeptide 3, 34kDa
  Uniprot ID: Q13889
  ENSP ID: ENSP00000228955
MVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 34444 - protein, 194 aa, Homo sapiens
  Payload ID: 6804
  Gene Symbol: GTF2H3
  Gene Name: general transcription factor IIH, polypeptide 3, 34kDa
  ENSP ID: ENSP00000438435
KDGKYELLTSANEVIVEEIKDLMTKSDIKGQHTETLLAGSLAKALCYIHRMNKEVKDNQEMKSRILVIKAAEDSALQYMNFMNVIFAAQKQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 34445 - protein, 67 aa, Homo sapiens
  Payload ID: 6804
  Gene Symbol: GTF2H3
  Gene Name: general transcription factor IIH, polypeptide 3, 34kDa
  ENSP ID: ENSP00000439121
MVSDEDELNLLVIVVDANPIWWGKQALKESQFTLSKCIDAVMVLGNSHLFMNRSNKLAVIASHIQER

SEQ ID NO: 34446 - protein, 200 aa, Homo sapiens
  Payload ID: 6804
  Gene Symbol: GTF2H3
  Gene Name: general transcription factor IIH, polypeptide 3, 34kDa
  ENSP ID: ENSP00000440482
MVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACVLDSDSGLLQQAQGIAHENLIPLETLVGVSSRSRSEISVNPPTPSSC

SEQ ID NO: 34447 - protein, 258 aa, Homo sapiens
  Payload ID: 6804
  Gene Symbol: GTF2H3
  Gene Name: general transcription factor IIH, polypeptide 3, 34kDa
  ENSP ID: ENSP00000441894
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILACDITGGLYLKVPQMPSLLQYLLWVFLPDQDQRSQLILPPPVHVDYRAACFCHRNLIEIGYVCSVCLSIFCNFSPICTTCETAFKISLPPVLKAKK

SEQ ID NO: 34448 - protein, 148 aa, Homo sapiens
  Payload ID: 6804
  Gene Symbol: GTF2H3
  Gene Name: general transcription factor IIH, polypeptide 3, 34kDa
  ENSP ID: ENSP00000442977
MVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILAQGIAHENLIPLETLVGVSSRSRSEIS

SEQ ID NO: 34449 - protein, 308 aa, Homo sapiens
  Payload ID: 6804
  Gene Symbol: GTF2H3
  Gene Name: general transcription factor IIH, polypeptide 3, 34kDa
  Uniprot ID: Q13889
  ENSP ID: ENSP00000445162
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 34450 - protein, 210 aa, Homo sapiens
  Payload ID: 6804
  Gene Symbol: GTF2H3
  Gene Name: general transcription factor IIH, polypeptide 3, 34kDa
  ENSP ID: ENSP00000446097
MVSDEDELNLLVIVVDANPIWWGKQALKESQHHHLMPQPPEYLGLQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACV

SEQ ID NO: 34451 - protein, 177 aa, Homo sapiens
  Payload ID: 6804
  Gene Symbol: GTF2H3
  Gene Name: general transcription factor IIH, polypeptide 3, 34kDa
  ENSP ID: ENSP00000446429
MVSDVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQ

SEQ ID NO: 34452 - protein, 162 aa, Homo sapiens
  Payload ID: 6804
  Gene Symbol: GTF2H3
  Gene Name: general transcription factor IIH, polypeptide 3, 34kDa
  ENSP ID: ENSP00000481711
MNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 34453 - protein, 462 aa, Homo sapiens
  Payload ID: 6805
  Gene Symbol: GTF2H4
  Gene Name: general transcription factor IIH, polypeptide 4, 52kDa
  Uniprot ID: Q92759
  ENSP ID: ENSP00000259895
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGGKAWSDDTSQLGPDKHARDVPSLDKYAEERWEVVLHFMVGSPSAAVSQDLAQLLSQAGLMKSTEPGEPPCITSAGFQFLLLDTPAQLWYFMLQYLQTAQSRGMDLVEILSFLFQLSFSTLGKDYSVEGMSDSLLNFLQHLREFGLVFQRKRKSRRYYPTRLAINLSSGVSGAGGTVHQPGFIVVETNYRLYAYTESELQIALIALFSEMLYRFPNMVVAQVTRESVQQAIASGITAQQIIHFLRTRAHPVMLKQTPVLPPTITDQIRLWELERDRLRFTEGVLYNQFLSQVDFELLLAHARELGVLVFENSAKRLMVVTPAGHSDVKRFWKRQKHSS

SEQ ID NO: 34454 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000365493

SEQ ID NO: 34455 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000365504

SEQ ID NO: 34456 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000383300

SEQ ID NO: 34457 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000387980

SEQ ID NO: 34458 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000388227

SEQ ID NO: 34459 - protein, 138 aa, Homo sapiens
  Payload ID: 6805
  Gene Symbol: GTF2H4
  Gene Name: general transcription factor IIH, polypeptide 4, 52kDa
  ENSP ID: ENSP00000389851
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGTGITGVSHCAWPG

SEQ ID NO: 34460 - protein, 138 aa, Homo sapiens; identical to SEQ ID NO: 34459
  Payload ID: 6805
  Gene Symbol: GTF2H4
  Gene Name: general transcription factor IIH, polypeptide 4, 52kDa
  ENSP ID: ENSP00000394961

SEQ ID NO: 34461 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000395497

SEQ ID NO: 34462 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000396251

SEQ ID NO: 34463 - protein, 138 aa, Homo sapiens; identical to SEQ ID NO: 34459
  Payload ID: 6805
  Gene Symbol: GTF2H4
  Gene Name: general transcription factor IIH, polypeptide 4, 52kDa
  ENSP ID: ENSP00000397410

SEQ ID NO: 34464 - protein, 138 aa, Homo sapiens; identical to SEQ ID NO: 34459
  Payload ID: 6805
  Gene Symbol: GTF2H4
  Gene Name: general transcription factor IIH, polypeptide 4, 52kDa
  ENSP ID: ENSP00000398484

SEQ ID NO: 34465 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000399554

SEQ ID NO: 34466 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000401105

SEQ ID NO: 34467 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000403156

SEQ ID NO: 34468 - protein, 462 aa, Homo sapiens; identical to SEQ ID NO: 34453
  Payload ID: 6805
  Gene Symbol: GTF2H4
  Gene Name: general transcription factor IIH, polypeptide 4, 52kDa
  Uniprot ID: Q92759
  ENSP ID: ENSP00000409483

SEQ ID NO: 34469 - protein, 138 aa, Homo sapiens; identical to SEQ ID NO: 34459
  Payload ID: 6805
  Gene Symbol: GTF2H4
  Gene Name: general transcription factor IIH, polypeptide 4, 52kDa
  ENSP ID: ENSP00000411553

SEQ ID NO: 34470 - protein, 71 aa, Homo sapiens
  Payload ID: 6806
  Gene Symbol: GTF2H5
  Gene Name: general transcription factor IIH, polypeptide 5
  Uniprot ID: Q6ZYL4
  ENSP ID: ENSP00000476100
MVNVLKGVLIECDPAMKQFLLYLDESNALGKKFIIQDIDDTHVFVIAELVNVLQERVGELMDQNAFSLTQK

SEQ ID NO: 34471 - protein, 274 aa, Homo sapiens
  Payload ID: 6807
  Gene Symbol: GTF2I
  Gene Name: general transcription factor IIi
  Uniprot ID: P78347
  ENSP ID: ENSP00000404240
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEG

SEQ ID NO: 34472 - protein, 106 aa, Homo sapiens
  Payload ID: 6807
  Gene Symbol: GTF2I
  Gene Name: general transcription factor IIi
  ENSP ID: ENSP00000405022
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDA

SEQ ID NO: 34473 - protein, 998 aa, Homo sapiens
  Payload ID: 6807
  Gene Symbol: GTF2I
  Gene Name: general transcription factor IIi
  Uniprot ID: P78347
  ENSP ID: ENSP00000460070
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQAGPSETDDVDEKQPLSKPLQGSHHSSEGNEGTEMEVPAEDSTQHVPSETSEDPEVEVTIEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 34474 - protein, 957 aa, Homo sapiens
  Payload ID: 6807
  Gene Symbol: GTF2I
  Gene Name: general transcription factor IIi
  Uniprot ID: P78347
  ENSP ID: ENSP00000477837
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 34475 - protein, 977 aa, Homo sapiens
  Payload ID: 6807
  Gene Symbol: GTF2I
  Gene Name: general transcription factor IIi
  Uniprot ID: P78347
  ENSP ID: ENSP00000482476
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQAGPSETDDVDEKQPLSKPLQGSHHSSEGNEGTEMEVPAEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 34476 - protein, 978 aa, Homo sapiens
  Payload ID: 6807
  Gene Symbol: GTF2I
  Gene Name: general transcription factor IIi
  Uniprot ID: P78347
  ENSP ID: ENSP00000484526
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEDSTQHVPSETSEDPEVEVTIEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 34477 - protein, 365 aa, Homo sapiens
  Payload ID: 6808
  Gene Symbol: GTF3A
  Gene Name: general transcription factor IIIA
  Uniprot ID: Q92664
  ENSP ID: ENSP00000370532
LDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYICSFEDCKKTFKKHQQLKIHQCQHTNEPLFKCTQEGCGKHFASPSKLKRHAKAHEGYVCQKGCSFVAKTWTELLKHVRETHKEEILCEVCRKTFKRKDYLKQHMKTHAPERDVCRCPREGCGRTYTTVFNLQSHILSFHEESRPFVCEHAGCGKTFAMKQSLTRHAVVHDPDKKKMKLKVKKSREKRSLASHLSGYIPPKRKQGQGLSLCQNGESPNCVEDKMLSTVAVLTLG

SEQ ID NO: 34478 - protein, 104 aa, Homo sapiens
  Payload ID: 6808
  Gene Symbol: GTF3A
  Gene Name: general transcription factor IIIA
  ENSP ID: ENSP00000387806
LDPPAVVAESVSSLTIADAFIAAGESSAPTPPRPALPRRFICSFPDCSANYSKAWKLDAHLCKHTGEVRGARLPTLGLGMARGPGVATAVVARAAGPAVQRVQL

SEQ ID NO: 34479 - protein, 188 aa, Homo sapiens
  Payload ID: 6808
  Gene Symbol: GTF3A
  Gene Name: general transcription factor IIIA
  ENSP ID: ENSP00000389655
LDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYICSFEDCKKTFKKHQQLKIHQCQHTNEPLFKLCMSKRMFLCGKNMDGTSETCERNP

SEQ ID NO: 34480 - protein, 422 aa, Homo sapiens
  Payload ID: 6808
  Gene Symbol: GTF3A
  Gene Name: general transcription factor IIIA
  ENSP ID: ENSP00000393050
MRSSGADAGRCLVTARAPGSVPASREGSAGSRGPGARFPARVSARGSAPGPGLGGAGALDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYICSFEDCKKTFKKHQQLKIHQCQHTNEPLFKCTQEGCGKHFASPSKLKRHAKAHEGYVCQKGCSFVAKTWTELLKHVRETHKEEILCEVCRKTFKRKDYLKQHMKTHAPERDVCRCPREGCGRTYTTVFNLQSHILSFHEESRPFVCEHAGCGKTFAMKQSLTRHAVVHDPDKKKMKLKVKKSREKRSLASSQWIYPPKRKQGQGLSLCQNGESPNCVEDKMLSTVAVLTLG

SEQ ID NO: 34481 - protein, 134 aa, Homo sapiens
  Payload ID: 6808
  Gene Symbol: GTF3A
  Gene Name: general transcription factor IIIA
  ENSP ID: ENSP00000409175
LDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYIF

SEQ ID NO: 34482 - protein, 2109 aa, Homo sapiens
  Payload ID: 6809
  Gene Symbol: GTF3C1
  Gene Name: general transcription factor IIIC, polypeptide 1, alpha 220kDa
  Uniprot ID: Q12789
  ENSP ID: ENSP00000348510
MDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 34483 - protein, 2084 aa, Homo sapiens
  Payload ID: 6809
  Gene Symbol: GTF3C1
  Gene Name: general transcription factor IIIC, polypeptide 1, alpha 220kDa
  Uniprot ID: Q12789
  ENSP ID: ENSP00000455417
MDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 34484 - protein, 180 aa, Homo sapiens
  Payload ID: 6809
  Gene Symbol: GTF3C1
  Gene Name: general transcription factor IIIC, polypeptide 1, alpha 220kDa
  ENSP ID: ENSP00000456187
  MOD_RES (1)..(1): Any amino acid
XKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKCVWQDLCQVRPVDKERLPFPPRRPQVCANEFKEFVEKLKEKFSSALRNSN

SEQ ID NO: 34485 - protein, 214 aa, Homo sapiens
  Payload ID: 6809
  Gene Symbol: GTF3C1
  Gene Name: general transcription factor IIIC, polypeptide 1, alpha 220kDa
  ENSP ID: ENSP00000457449
  MOD_RES (1)..(1): Any amino acid
XRNLIIEAVTNLRLIESLFTIQKMIMDQEKQEDQEGVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 34486 - protein, 139 aa, Homo sapiens
  Payload ID: 6809
  Gene Symbol: GTF3C1
  Gene Name: general transcription factor IIIC, polypeptide 1, alpha 220kDa
  ENSP ID: ENSP00000457476
AGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGYVKKAKGCATMMKPTRVPCSG

SEQ ID NO: 34487 - protein, 84 aa, Homo sapiens
  Payload ID: 6809
  Gene Symbol: GTF3C1
  Gene Name: general transcription factor IIIC, polypeptide 1, alpha 220kDa
  ENSP ID: ENSP00000459231
FLVLQNLIQSTLALSDSQMKSYQSFQTFRLYREYKDHVLVKAFMECQKRSLVNRRRVNHTLGPKKNRALPFVPMSYQLSQTYYR

SEQ ID NO: 34488 - protein, 911 aa, Homo sapiens
  Payload ID: 6810
  Gene Symbol: GTF3C2
  Gene Name: general transcription factor IIIC, polypeptide 2, beta 110kDa
  Uniprot ID: Q8WUA4
  ENSP ID: ENSP00000264720
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKVRFSPNLDSYGWLVSGGQSGLVRIHFVRGLASPLGHRMQLESRAHFNAMFQPSSPTRRPGFSPTSHRLLPTP

SEQ ID NO: 34489 - protein, 911 aa, Homo sapiens; identical to SEQ ID NO: 34488
  Payload ID: 6810
  Gene Symbol: GTF3C2
  Gene Name: general transcription factor IIIC, polypeptide 2, beta 110kDa
  Uniprot ID: Q8WUA4
  ENSP ID: ENSP00000352536

SEQ ID NO: 34490 - protein, 134 aa, Homo sapiens
  Payload ID: 6810
  Gene Symbol: GTF3C2
  Gene Name: general transcription factor IIIC, polypeptide 2, beta 110kDa
  ENSP ID: ENSP00000389518
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNP

SEQ ID NO: 34491 - protein, 420 aa, Homo sapiens
  Payload ID: 6810
  Gene Symbol: GTF3C2
  Gene Name: general transcription factor IIIC, polypeptide 2, beta 110kDa
  ENSP ID: ENSP00000393429
  MOD_RES (1)..(1): Any amino acid
XFAVLQLYSFSTFPFISPFFPLLCSQDFPPLAATDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKVRFSPNLDSYGWLVSGGQSGLVRIHFVRGLASPLGHRMQLESRAHFNAMFQPSSPTRRPGFSPTSHRLLPTP

SEQ ID NO: 34492 - protein, 79 aa, Homo sapiens
  Payload ID: 6810
  Gene Symbol: GTF3C2
  Gene Name: general transcription factor IIIC, polypeptide 2, beta 110kDa
  ENSP ID: ENSP00000399339
  MOD_RES (1)..(1): Any amino acid
XYTETVNHHYLLFQDTDLGSFHDLLRREPMLRMQEGEGHSQLCLDRLQLEAIHKTAWLLSNQPSPSAHSLALAHTRSLE

SEQ ID NO: 34493 - protein, 74 aa, Homo sapiens
  Payload ID: 6810
  Gene Symbol: GTF3C2
  Gene Name: general transcription factor IIIC, polypeptide 2, beta 110kDa
  ENSP ID: ENSP00000408174
MDTCGVGYVALGEAGPVGNMTVVDSPGQEVLNQLDVKTSSEMTSAEASVEMSLPTPLPGFEDSPDQRRLPPEQE

SEQ ID NO: 34494 - protein, 142 aa, Homo sapiens
  Payload ID: 6810
  Gene Symbol: GTF3C2
  Gene Name: general transcription factor IIIC, polypeptide 2, beta 110kDa
  ENSP ID: ENSP00000409043
  MOD_RES (1)..(1): Any amino acid
XVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKGNHHVCPRG

SEQ ID NO: 34495 - protein, 181 aa, Homo sapiens
  Payload ID: 6810
  Gene Symbol: GTF3C2
  Gene Name: general transcription factor IIIC, polypeptide 2, beta 110kDa
  ENSP ID: ENSP00000414422
  MOD_RES (1)..(1): Any amino acid
XSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFVRIRTSNSSCWILTHMPSQILLYIKQI

SEQ ID NO: 34496 - protein, 584 aa, Homo sapiens
  Payload ID: 6810
  Gene Symbol: GTF3C2
  Gene Name: general transcription factor IIIC, polypeptide 2, beta 110kDa
  ENSP ID: ENSP00000482584
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGKNQNKT

SEQ ID NO: 34497 - protein, 886 aa, Homo sapiens
  Payload ID: 6811
  Gene Symbol: GTF3C3
  Gene Name: general transcription factor IIIC, polypeptide 3, 102kDa
  Uniprot ID: Q9Y5Q9
  ENSP ID: ENSP00000263956
MSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAECLKALGYMERAAESYGKVVDLAPLHLDARISLSTLQQQLGQPEKALEALEPMYDPDTLAQDANAAQQELKLLLHRSTLLFSQGKMYGYVDTLLTMLAMLLKVAMNRAQVCLISSSKSGERHLYLIKVSRDKISDSNDQESANCDAKAIFAVLTSVLTKDDWWNLLLKAIYSLCDLSRFQEAELLVDSSLEYYSFYDDRQKRKELEYFGLSAAILDKNFRKAYNYIRIMVMENVNKPQLWNIFNQVTMHSQDVRHHRFCLRLMLKNPENHALCVLNGHNAFVSGSFKHALGQYVQAFRTHPDEPLYSFCIGLTFIHMASQKYVLRRHALIVQGFSFLNRYLSLRGPCQESFYNLGRGLHQLGLIHLAIHYYQKALELPPLVVEGIELDQLDLRRDIAYNLSLIYQSSGNTGMAQTLLYTYCSI

SEQ ID NO: 34498 - protein, 413 aa, Homo sapiens
  Payload ID: 6811
  Gene Symbol: GTF3C3
  Gene Name: general transcription factor IIIC, polypeptide 3, 102kDa
  Uniprot ID: Q9Y5Q9
  ENSP ID: ENSP00000386465
MSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNVCNKICT

SEQ ID NO: 34499 - protein, 6 aa, Homo sapiens
  Payload ID: 6811
  Gene Symbol: GTF3C3
  Gene Name: general transcription factor IIIC, polypeptide 3, 102kDa
  ENSP ID: ENSP00000389992
KKVRRC

SEQ ID NO: 34500 - protein, 109 aa, Homo sapiens
  Payload ID: 6811
  Gene Symbol: GTF3C3
  Gene Name: general transcription factor IIIC, polypeptide 3, 102kDa
  ENSP ID: ENSP00000391724
  MOD_RES (1)..(1): Any amino acid
XANAAQQELKLLLHRSTLLFSQGKMYGYVDTLLTMLAMLLKMVLSSCRKTSSGLPLILHYAIFAVLTSVLTKDDWWNLLLKAIYSLCDLSRFQEAELLVDSSLEYYSFY

SEQ ID NO: 34501 - protein, 148 aa, Homo sapiens
  Payload ID: 6811
  Gene Symbol: GTF3C3
  Gene Name: general transcription factor IIIC, polypeptide 3, 102kDa
  ENSP ID: ENSP00000394065
SYGKVVDLAPLHLDARISLSTLQQQLGQPEKALEALEPMYDPDTLAQDANAAQQELKLLLHRSTLLFSQGKMYGYVDTLLTMLAMLLKVAMNRAQVCLISSSKSGERHLYLIKVSRDKISDSNDQESANCDAKGNNFICIMLYKIWLN

SEQ ID NO: 34502 - protein, 161 aa, Homo sapiens
  Payload ID: 6811
  Gene Symbol: GTF3C3
  Gene Name: general transcription factor IIIC, polypeptide 3, 102kDa
  ENSP ID: ENSP00000398385
AFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAGNTFLWEEEVLII

SEQ ID NO: 34503 - protein, 38 aa, Homo sapiens
  Payload ID: 6811
  Gene Symbol: GTF3C3
  Gene Name: general transcription factor IIIC, polypeptide 3, 102kDa
  ENSP ID: ENSP00000406685
MSGFSPELIDYLEGKISFEEFERRREERKTREKKVRRC

SEQ ID NO: 34504 - protein, 44 aa, Homo sapiens
  Payload ID: 6811
  Gene Symbol: GTF3C3
  Gene Name: general transcription factor IIIC, polypeptide 3, 102kDa
  ENSP ID: ENSP00000438797
  MOD_RES (1)..(1): Any amino acid
XTDPVNMSGFSPELIDYLEGKISFEEFERRREERKTREKKVRRC

SEQ ID NO: 34505 - protein, 822 aa, Homo sapiens
  Payload ID: 6812
  Gene Symbol: GTF3C4
  Gene Name: general transcription factor IIIC, polypeptide 4, 90kDa
  Uniprot ID: Q9UKN8
  ENSP ID: ENSP00000361219
MNTADQARVGPADDGPAPSGEEEGEGGGEAGGKEPAADAAPGPSAAFRLMVTRREPAVKLQYAVSGLEPLAWSEDHRVSVSTARSIAVLELICDVHNPGQDLVIHRTSVPAPLNSCLLKVGSKTEVAECKEKFAASKDPTVSQTFMLDRVFNPEGKALPPMRGFKYTSWSPMGCDANGRCLLAALTMDNRLTIQANLNRLQWVQLVDLTEIYGERLYETSYRLSKNEAPEGNLGDFAEFQRRHSMQTPVRMEWSGICTTQQVKHNNECRDVGSVLLAVLFENGNIAVWQFQLPFVGKESISSCNTIESGITSPSVLFWWEYEHNNRKMSGLIVGSAFGPIKILPVNLKAVKGYFTLRQPVILWKEMDQLPVHSIKCVPLYHPYQKCSCSLVVAARGSYVFWCLLLISKAGLNVHNSHVTGLHSLPIVSMTADKQNGTVYTCSSDGKVRQLIPIFTDVALKFEHQLIKLSDVFGSVRTHGIAVSPCGAYLAIITTEGMINGLHPVNKNYQVQFVTLKTFEEAAAQLLESSVQNLFKQVDLIDLVRWKILKDKHIPQFLQEALEKKIESSGVTYFWRFKLFLLRILYQSMQKTPSEALWKPTHEDSKILLVDSPGMGNADDEQQEEGTSSKQVVKQGLQERSKEGDVEEPTDDSLPTTGDAGGREPMEEKLLEIQGKIEAVEMHLTREHMKRVLGEVYLHTWITENTSIPTRGLCNFLMSDEEYDDRTARVLIGHISKKMNKQTFPEHCSLCKEILPFTDRKQAVCSNGHIWLRCFLTYQSCQSLIYRRCLLHDSIARHPAPEDPDWIKRLLQSPCPFCDSPVF

SEQ ID NO: 34506 - protein, 149 aa, Homo sapiens
  Payload ID: 6812
  Gene Symbol: GTF3C4
  Gene Name: general transcription factor IIIC, polypeptide 4, 90kDa
  ENSP ID: ENSP00000431378
MNTADQARVGPADDGPAPSGEEEGEGGGEAGGKEPAADAAPGPSAAFRLMVTRREPAVKLQYAVSGLEPLAWSEDHRVSVSTARSIAVLELICDVHNPGQDLVIHRTSVPAPLNSCLLKVGSKTEVAECKEKFAASKDPTAFTHCQLSP

SEQ ID NO: 34507 - protein, 457 aa, Homo sapiens
  Payload ID: 6813
  Gene Symbol: GTF3C5
  Gene Name: general transcription factor IIIC, polypeptide 5, 63kDa
  ENSP ID: ENSP00000339530
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKHLWIRFGYDPRKNPDAKIYQVLDFRIRCGMKHGYAPSDLPVKAKRSTYNYSLPITVKKTSSQLVTMHDLKQGLGPSGTSGARKPASSKYKLKVSLQTLRDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 34508 - protein, 519 aa, Homo sapiens
  Payload ID: 6813
  Gene Symbol: GTF3C5
  Gene Name: general transcription factor IIIC, polypeptide 5, 63kDa
  Uniprot ID: Q9Y5Q8
  ENSP ID: ENSP00000361169
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 34509 - protein, 345 aa, Homo sapiens
  Payload ID: 6813
  Gene Symbol: GTF3C5
  Gene Name: general transcription factor IIIC, polypeptide 5, 63kDa
  ENSP ID: ENSP00000361171
MWLRCCRLWAARKASPGEGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 34510 - protein, 526 aa, Homo sapiens
  Payload ID: 6813
  Gene Symbol: GTF3C5
  Gene Name: general transcription factor IIIC, polypeptide 5, 63kDa
  Uniprot ID: Q9Y5Q8
  ENSP ID: ENSP00000361180
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKVSLQTLRDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 34511 - protein, 244 aa, Homo sapiens
  Payload ID: 6813
  Gene Symbol: GTF3C5
  Gene Name: general transcription factor IIIC, polypeptide 5, 63kDa
  ENSP ID: ENSP00000389498
MTRAIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYM

SEQ ID NO: 34512 - protein, 224 aa, Homo sapiens
  Payload ID: 6813
  Gene Symbol: GTF3C5
  Gene Name: general transcription factor IIIC, polypeptide 5, 63kDa
  ENSP ID: ENSP00000393207
MSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSL

SEQ ID NO: 34513 - protein, 90 aa, Homo sapiens
  Payload ID: 6813
  Gene Symbol: GTF3C5
  Gene Name: general transcription factor IIIC, polypeptide 5, 63kDa
  ENSP ID: ENSP00000397961
  MOD_RES (1)..(1): Any amino acid
XIRCGMKHGYAPSDLPVKAKRSTYNYSLPITVKKTSSQLVTMHDLKQGLGPSGTSGARKPASSKYKLKVGAPGGQEWRGGLPSWGRAPCG

SEQ ID NO: 34514 - protein, 213 aa, Homo sapiens
  Payload ID: 6814
  Gene Symbol: GTF3C6
  Gene Name: general transcription factor IIIC, polypeptide 6, alpha 35kDa
  Uniprot ID: Q969F1
  ENSP ID: ENSP00000357863
MAAAADERSPEDGEDEEEEEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEEEIQMNDSSNLSCEQEKPMHLEIEDSGPLIDIPSETEGSVFMETQMLP

SEQ ID NO: 34515 - protein, 736 aa, Homo sapiens
  Payload ID: 6815
  Gene Symbol: GPHN
  Gene Name: gephyrin
  Uniprot ID: Q9NQX3
  ENSP ID: ENSP00000312771
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 34516 - protein, 769 aa, Homo sapiens
  Payload ID: 6815
  Gene Symbol: GPHN
  Gene Name: gephyrin
  Uniprot ID: Q9NQX3
  ENSP ID: ENSP00000417901
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 34517 - protein, 782 aa, Homo sapiens
  Payload ID: 6815
  Gene Symbol: GPHN
  Gene Name: gephyrin
  ENSP ID: ENSP00000438404
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEKFPTFPFCGLQKGATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKQIRRPDESKGVASRVGSLKARLPSCSSTYSVSEVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 34518 - protein, 60 aa, Homo sapiens
  Payload ID: 6815
  Gene Symbol: GPHN
  Gene Name: gephyrin
  ENSP ID: ENSP00000450442
  MOD_RES (1)..(1): Any amino acid
XLLMLPPKTEHAKRRLTGWRLCLASRTIPCRASREVSRPNSLTAQYSWAVTGHLLFEETN

SEQ ID NO: 34519 - protein, 280 aa, Homo sapiens
  Payload ID: 6815
  Gene Symbol: GPHN
  Gene Name: gephyrin
  ENSP ID: ENSP00000450706
ETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKQIRRPDESKGVASRVGSLKVQSRCSSKENILRASHSAVDITKVARRHRMSPFPLTSMDK

SEQ ID NO: 34520 - protein, 50 aa, Homo sapiens
  Payload ID: 6815
  Gene Symbol: GPHN
  Gene Name: gephyrin
  ENSP ID: ENSP00000451056
MATEGMILTNHDHQIRVGVLTVSDSCFRNLAEDRSGINLKDLVQDPSLKP

SEQ ID NO: 34521 - protein, 39 aa, Homo sapiens
  Payload ID: 6815
  Gene Symbol: GPHN
  Gene Name: gephyrin
  ENSP ID: ENSP00000451725
MATEGMILTNHDHQIRVGVLTVGMEFHRVSQDGLDLLTL

SEQ ID NO: 34522 - protein, 49 aa, Homo sapiens
  Payload ID: 6815
  Gene Symbol: GPHN
  Gene Name: gephyrin
  ENSP ID: ENSP00000451790
MATEGMILTNHDHQIRVGVLTVSDSCFRNLAEDRSGINLKDLVQDPSLG

SEQ ID NO: 34523 - protein, 49 aa, Homo sapiens; identical to SEQ ID NO: 34522
  Payload ID: 6815
  Gene Symbol: GPHN
  Gene Name: gephyrin
  ENSP ID: ENSP00000451935

SEQ ID NO: 34524 - protein, 201 aa, Homo sapiens
  Payload ID: 6815
  Gene Symbol: GPHN
  Gene Name: gephyrin
  ENSP ID: ENSP00000452009
HMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARVMLSNDQKPKWKPGNS

SEQ ID NO: 34525 - protein, 380 aa, Homo sapiens
  Payload ID: 6815
  Gene Symbol: GPHN
  Gene Name: gephyrin
  ENSP ID: ENSP00000452220
MATEGMILTNHDHQIRVGVLTVSDSCFRNLAEDRSGINLKDLVQDPSLLGGTISAYKIVPDEIEEIKKFPTFPFCGLQKGATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRGTIIFDHCPFFSSFFSK

SEQ ID NO: 34526 - protein, 300 aa, Homo sapiens [sequence omitted]

SEQ ID NO: 34527 - protein, 300 aa, Homo sapiens [sequence omitted]

SEQ ID NO: 34528 - protein, 246 aa, Homo sapiens
  Payload ID: 6816
  Gene Symbol: GGPS1
  Gene Name: geranylgeranyl diphosphate synthase 1
  Uniprot ID: O95749
  ENSP ID: ENSP00000375728
MLHNASLLIDDIEDNSKLRRGFPVAHSIYGIPSVINSANYVYFLGLEKVLTLDHPDAVKLFTRQLLELHQGQGLDIYWRDNYTCPTEEEYKAMVLQKTGGLFGLAVGLMQLFSDYKEDLKPLLNTLGLFFQIRDDYANLHSKEYSENKSFCEDLTEGKFSFPTIHAIWSRPESTQVQNILRQRTENIDIKKYCVHYLEDVGSFEYTRNTLKELEAKAYKQIDARGGNPELVALVKHLSKMFKEENE

SEQ ID NO: 34529 - protein, 242 aa, Homo sapiens
  Payload ID: 6816
  Gene Symbol: GGPS1
  Gene Name: geranylgeranyl diphosphate synthase 1
  ENSP ID: ENSP00000417772
MEKTQETVQRILLEPYKYLLQLPGKQVRTKLSQAFNHWLKVPEDKLQIIIEVTEMLHNASLLIDDIEDNSKLRRGFPVAHSIYGIPSVINSANYVYFLGLEKVLTLDHPDAVKLFTRQLLELHQGQGLDIYWRDNYTCPTEEEYKAMVLQKTGGLFGLAVGLMQLFSDYKEDLKPLLNTLGLFFQIRDDYANLHSKEYSENKSFCEDLTEGKFSFPTIHAIWSRPESTQVQNILRQRTENID

SEQ ID NO: 34530 - protein, 230 aa, Homo sapiens
  Payload ID: 6816
  Gene Symbol: GGPS1
  Gene Name: geranylgeranyl diphosphate synthase 1
  ENSP ID: ENSP00000417865
MEKTQETVQRILLEPYKYLLQLPGKQVRTKLSQAFNHWLKVPEDKLQIIIEVTEMLHNASLLIDDIEDNSKLRRGFPVAHSIYGIPSVINSANYVYFLGLEKVLTLDHPDAVKLFTRQLLELHQGQGLDIYWRDNYTCPTEEEYKAMVLQKTGGLFGLAVGLMQLFSDYKEDLKPLLNTLGLFFQIRDDYANLHSKEYSENKSFCEDLTEGKFSFPTIHAIWSRPESTQV

SEQ ID NO: 34531 - protein, 300 aa, Homo sapiens [sequence omitted]

SEQ ID NO: 34532 - protein, 326 aa, Homo sapiens
  Payload ID: 6817
  Gene Symbol: GSG1
  Gene Name: germ cell associated 1
  Uniprot ID: Q2KHT4
  ENSP ID: ENSP00000336816
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 34533 - protein, 321 aa, Homo sapiens
  Payload ID: 6817
  Gene Symbol: GSG1
  Gene Name: germ cell associated 1
  ENSP ID: ENSP00000336857
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 34534 - protein, 285 aa, Homo sapiens
  Payload ID: 6817
  Gene Symbol: GSG1
  Gene Name: germ cell associated 1
  Uniprot ID: Q2KHT4
  ENSP ID: ENSP00000379596
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 34535 - protein, 275 aa, Homo sapiens
  Payload ID: 6817
  Gene Symbol: GSG1
  Gene Name: germ cell associated 1
  Uniprot ID: Q2KHT4
  ENSP ID: ENSP00000398384
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 34536 - protein, 339 aa, Homo sapiens
  Payload ID: 6817
  Gene Symbol: GSG1
  Gene Name: germ cell associated 1
  Uniprot ID: Q2KHT4
  ENSP ID: ENSP00000405032
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 34537 - protein, 220 aa, Homo sapiens
  Payload ID: 6817
  Gene Symbol: GSG1
  Gene Name: germ cell associated 1
  ENSP ID: ENSP00000439676
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPAKSEMEEELKKCVYLHLYLLLCHLALLHPQSWKQFRALRSSGTAAAKGERCRSFIELTPPAKREILWLSLGTQITYIGLQFISFLLLLTDLLLTGNPAC

SEQ ID NO: 34538 - protein, 211 aa, Homo sapiens
  Payload ID: 6817
  Gene Symbol: GSG1
  Gene Name: germ cell associated 1
  ENSP ID: ENSP00000440684
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPAKSEMEEELKKCVYLHLYLLLCHLALLHPQSWKQFRALRSSGTAAAKGERCRSFIELTPPAKRGEKGLLEFATLQGPCHPTLRFGGKRLMEKASLPSPPLGLC

SEQ ID NO: 34539 - protein, 298 aa, Homo sapiens
  Payload ID: 6817
  Gene Symbol: GSG1
  Gene Name: germ cell associated 1
  Uniprot ID: Q2KHT4
  ENSP ID: ENSP00000441718
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKRGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 34540 - protein, 236 aa, Homo sapiens
  Payload ID: 6817
  Gene Symbol: GSG1
  Gene Name: germ cell associated 1
  ENSP ID: ENSP00000445884
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGG

SEQ ID NO: 34541 - protein, 798 aa, Homo sapiens
  Payload ID: 6818
  Gene Symbol: GSG2
  Gene Name: germ cell associated 2 (haspin)
  Uniprot ID: Q8TF76
  ENSP ID: ENSP00000325290
MAASLPGPGSRLFRTYGAADGRRQRRPGREAAQWFPPQDRRRFFNSSGSSDASIGDPSQSDDPDDPDDPDFPGSPVRRRRRRPGGRVPKDRPSLTVTPKRWKLRARPSLTVTPRRLGLRARPPQKCSTPCGPLRLPPFPSRDSGRLSPDLSVCGQPRDGDELGISASLFSSLASPCPGSPTPRDSVISIGTSACLVAASAVPSGLHLPEVSLDRASLPCSQEEATGGAKDTRMVHQTRASLRSVLFGLMNSGTPEDSEFRADGKNMRESCCKRKLVVGNGPEGPGLSSTGKRRATGQDSCQERGLQEAVRREHQEASVPKGRIVPRGIDRLERTRSSRKSKHQEATETSLLHSHRFKKGQKLGKDSFPTQDLTPLQNVCFWTKTRASFSFHKKKIVTDVSEVCSIYTTATSLSGSLLSECSNRPVMNRTSGAPSSWHSSSMYLLSPLNTLSISNKKASDAEKVYGECSQKGPVPFSHCLPTEKLQRCEKIGEGVFGEVFQTIADHTPVAIKIIAIEGPDLVNGSHQKTFEEILPEIIISKELSLLSGEVCNRTEGFIGLNSVHCVQGSYPPLLLKAWDHYNSTKGSANDRPDFFKDDQLFIVLEFEFGGIDLEQMRTKLSSLATAKSILHQLTASLAVAEASLRFEHRDLHWGNVLLKKTSLKKLHYTLNGKSSTIPSCGLQVSIIDYTLSRLERDGIVVFCDVSMDEDLFTGDGDYQFDIYRLMKKENNNRWGEYHPYSNVLWLHYLTDKMLKQMTFKTKCNTPAMKQIKRKIQEFHRTMLNFSSATDLLCQHSLFK

SEQ ID NO: 34542 - protein, 515 aa, Homo sapiens
  Payload ID: 6819
  Gene Symbol: GMCL1
  Gene Name: germ cell-less, spermatogenesis associated 1
  Uniprot ID: Q96IK5
  ENSP ID: ENSP00000282570
MGSLSSRVLRQPRPALAQQAQGARAGGSARRPDTGDDAAGHGFCYCAGSHKRKRSSGSFCYCHPDSETDEDEEEGDEQQRLLNTPRRKKLKSTSKYIYQTLFLNGENSDIKICALGEEWSLHKIYLCQSGYFSSMFSGSWKESSMNIIELEIPDQNIDVEALQVAFGSLYRDDVLIKPSRVVAILAAACLLQLDGLIQQCGETMKETVNVKTVCGYYTSAGTYGLDSVKKKCLEWLLNNLMTHQNVELFKELSINVMKQLIGSSNLFVMQVEMDIYTALKKWMFLQLVPSWNGSLKQLLTETDVWFSKQRKDFEGMAFLETEQGKPFVSVFRHLRLQYIISDLASARIIEQDAVVPSEWLSSVYKQQWFAMLRAEQDSEVGPQEINKEELEGNSMRCGRKLAKDGEYCWRWTGFNFGFDLLVTYTNRYIIFKRNTLNQPCSGSVSLQPRRSIAFRLRLASFDSSGKLICSRTTGYQILTLEKDQEQVVMNLDSRLLIFPLYICCNFLYISPEKKN

SEQ ID NO: 34543 - protein, 178 aa, Homo sapiens
  Payload ID: 6820
  Gene Symbol: GCSAM
  Gene Name: germinal center-associated, signaling and motility
  Uniprot ID: Q8N6F7
  ENSP ID: ENSP00000309487
MGNSLLRENRRQQNTQEMPWNVRMQSPKQRTSRCWDHHIAEGCFCLPWKKILIFEKRQDSQNENERMSSTPIQDNVDQTYSEELCYTLINHRVLCTRPSGNSAEEYYENVPCKAERPRESLGGTETEYSLLHMPSTDPRHARSPEDEYELLMPHRISSHFLQQPRPLMAPSETQFSHL

SEQ ID NO: 34544 - protein, 47 aa, Homo sapiens
  Payload ID: 6820
  Gene Symbol: GCSAM
  Gene Name: germinal center-associated, signaling and motility
  ENSP ID: ENSP00000417322
MGNSLLRENRRQQNTQEMPWNVRMQSPKQRTSRKTKAFYHERCVQVI

SEQ ID NO: 34545 - protein, 47 aa, Homo sapiens; identical to SEQ ID NO: 34544
  Payload ID: 6820
  Gene Symbol: GCSAM
  Gene Name: germinal center-associated, signaling and motility
  ENSP ID: ENSP00000418558

SEQ ID NO: 34546 - protein, 111 aa, Homo sapiens
  Payload ID: 6820
  Gene Symbol: GCSAM
  Gene Name: germinal center-associated, signaling and motility
  ENSP ID: ENSP00000418849
MPWNVRMQSPKQRTSRCWDHHIAEGCFCLPWKKILIFEKRQDSQNENERMSSTPIQDNVDQTYSEELCYTLINHRVLCTRPSGNSAEEYYENVPCKAERPRESLGGTETEY

SEQ ID NO: 34547 - protein, 180 aa, Homo sapiens
  Payload ID: 6820
  Gene Symbol: GCSAM
  Gene Name: germinal center-associated, signaling and motility
  Uniprot ID: Q8N6F7
  ENSP ID: ENSP00000419485
MGNSLLRENSFRRQQNTQEMPWNVRMQSPKQRTSRCWDHHIAEGCFCLPWKKILIFEKRQDSQNENERMSSTPIQDNVDQTYSEELCYTLINHRVLCTRPSGNSAEEYYENVPCKAERPRESLGGTETEYSLLHMPSTDPRHARSPEDEYELLMPHRISSHFLQQPRPLMAPSETQFSHL

SEQ ID NO: 34548 - protein, 126 aa, Homo sapiens
  Payload ID: 6820
  Gene Symbol: GCSAM
  Gene Name: germinal center-associated, signaling and motility
  ENSP ID: ENSP00000419913
MPWNVRMQSPKQRTSRCWDHHIAEGCFCLPWKKILIFEKRQDSQNENERMSSTPIQDNVDQTYSEELCYTLINHRVLCTRPSGNSAEEYYENVPCKAERPRESLGGTETEYSLLHMPSTDPRHARS

SEQ ID NO: 34549 - protein, 163 aa, Homo sapiens
  Payload ID: 6820
  Gene Symbol: GCSAM
  Gene Name: germinal center-associated, signaling and motility
  Uniprot ID: Q8N6F7
  ENSP ID: ENSP00000420603
MGNSLLRENRRQQNTQEMPWNVRMQSPKQRTSRKKILIFEKRQDSQNENERMSSTPIQDNVDQTYSEELCYTLINHRVLCTRPSGNSAEEYYENVPCKAERPRESLGGTETEYSLLHMPSTDPRHARSPEDEYELLMPHRISSHFLQQPRPLMAPSETQFSHL

SEQ ID NO: 34550 - protein, 135 aa, Homo sapiens
  Payload ID: 6821
  Gene Symbol: GCSAML
  Gene Name: germinal center-associated, signaling and motility-like
  Uniprot ID: Q5JQS6
  ENSP ID: ENSP00000355444
MGNYLLRKLSCLGENQKKPKKGNPDEERKRQEMTTFERKLQDQDKKSQEVSSTSNQENENGSGSEEVCYTVINHIPHQRSSLSSNDDGYENIDSLTRKVRQFRERSETEYALLRTSVSRPCSCTHEHDYEVVFPH

SEQ ID NO: 34551 - protein, 115 aa, Homo sapiens
  Payload ID: 6821
  Gene Symbol: GCSAML
  Gene Name: germinal center-associated, signaling and motility-like
  Uniprot ID: Q5JQS6
  ENSP ID: ENSP00000355445
MGNYLLRKLRQEMTTFERKLQDQDKKSQEVSSTSNQENENGSGSEEVCYTVINHIPHQRSSLSSNDDGYENIDSLTRKVRQFRERSETEYALLRTSVSRPCSCTHEHDYEVVFPH

SEQ ID NO: 34552 - protein, 115 aa, Homo sapiens; identical to SEQ ID NO: 34551
  Payload ID: 6821
  Gene Symbol: GCSAML
  Gene Name: germinal center-associated, signaling and motility-like
  Uniprot ID: Q5JQS6
  ENSP ID: ENSP00000355447

SEQ ID NO: 34553 - protein, 103 aa, Homo sapiens
  Payload ID: 6821
  Gene Symbol: GCSAML
  Gene Name: germinal center-associated, signaling and motility-like
  ENSP ID: ENSP00000432118
MTTFERKLQDQDKKSQEVSSTSNQENENGSGSEEVCYTVINHIPHQRSSLSSNDDGYENIDSLTRKVRQFRERSETEYALLRTSVSRPCSCTHEHDYEVVFPH

SEQ ID NO: 34554 - protein, 74 aa, Homo sapiens
  Payload ID: 6821
  Gene Symbol: GCSAML
  Gene Name: germinal center-associated, signaling and motility-like
  ENSP ID: ENSP00000434084
MTTFERKLQDQDKKSQEVSSTSNQENENGSGSEEVCYTVINHIPHQRSSLSSNDDGYENIDSLTRKVRQFRERS

SEQ ID NO: 34555 - protein, 103 aa, Homo sapiens; identical to SEQ ID NO: 34553
  Payload ID: 6821
  Gene Symbol: GCSAML
  Gene Name: germinal center-associated, signaling and motility-like
  ENSP ID: ENSP00000434526

SEQ ID NO: 34556 - protein, 103 aa, Homo sapiens; identical to SEQ ID NO: 34553
  Payload ID: 6821
  Gene Symbol: GCSAML
  Gene Name: germinal center-associated, signaling and motility-like
  ENSP ID: ENSP00000435110

SEQ ID NO: 34557 - protein, 80 aa, Homo sapiens
  Payload ID: 6821
  Gene Symbol: GCSAML
  Gene Name: germinal center-associated, signaling and motility-like
  ENSP ID: ENSP00000436079
MGNYLLRKLSCLGENQKKPKKGNPDEERKRQEMTTFERKLQDQDKKSQEVSSTSNQENENGSGSEEVCYTVINHIPHQRS

SEQ ID NO: 34558 - protein, 135 aa, Homo sapiens; identical to SEQ ID NO: 34550
  Payload ID: 6821
  Gene Symbol: GCSAML
  Gene Name: germinal center-associated, signaling and motility-like
  Uniprot ID: Q5JQS6
  ENSP ID: ENSP00000446460

SEQ ID NO: 34559 - protein, 103 aa, Homo sapiens; identical to SEQ ID NO: 34553
  Payload ID: 6821
  Gene Symbol: GCSAML
  Gene Name: germinal center-associated, signaling and motility-like
  ENSP ID: ENSP00000485175

SEQ ID NO: 34560 - protein, 530 aa, Homo sapiens
  Payload ID: 6822
  Gene Symbol: GHDC
  Gene Name: GH3 domain containing
  Uniprot ID: Q8N2G8
  ENSP ID: ENSP00000301671
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 34561 - protein, 474 aa, Homo sapiens
  Payload ID: 6822
  Gene Symbol: GHDC
  Gene Name: GH3 domain containing
  Uniprot ID: Q8N2G8
  ENSP ID: ENSP00000399952
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILEWGRTDRAEDTRLGSCPFTGSMCAHGVYSQIPLRALLPTTRCLWR

SEQ ID NO: 34562 - protein, 474 aa, Homo sapiens; identical to SEQ ID NO: 34561
  Payload ID: 6822
  Gene Symbol: GHDC
  Gene Name: GH3 domain containing
  Uniprot ID: Q8N2G8
  ENSP ID: ENSP00000410945

SEQ ID NO: 34563 - protein, 112 aa, Homo sapiens
  Payload ID: 6822
  Gene Symbol: GHDC
  Gene Name: GH3 domain containing
  ENSP ID: ENSP00000465315
MLLWPLLLLLLLLPTLALLRQQRSQDARLSWLAGLQHRVAWGALVWAATWQRRRLEQSTLHVHQSQQQALRWCLQGAQRPHCSLRRSTGSHQSCLKLLGNWLPEAFLLSLGL

SEQ ID NO: 34564 - protein, 146 aa, Homo sapiens
  Payload ID: 6822
  Gene Symbol: GHDC
  Gene Name: GH3 domain containing
  ENSP ID: ENSP00000465924
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVL

SEQ ID NO: 34565 - protein, 530 aa, Homo sapiens; identical to SEQ ID NO: 34560
  Payload ID: 6822
  Gene Symbol: GHDC
  Gene Name: GH3 domain containing
  Uniprot ID: Q8N2G8
  ENSP ID: ENSP00000467585

SEQ ID NO: 34566 - protein, 130 aa, Homo sapiens
  Payload ID: 6822
  Gene Symbol: GHDC
  Gene Name: GH3 domain containing
  ENSP ID: ENSP00000467660
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQA

SEQ ID NO: 34567 - protein, 479 aa, Homo sapiens
  Payload ID: 6822
  Gene Symbol: GHDC
  Gene Name: GH3 domain containing
  ENSP ID: ENSP00000468790
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKILASGSALGKREWTPAQPFPH

SEQ ID NO: 34568 - protein, 116 aa, Homo sapiens
  Payload ID: 6823
  Gene Symbol: GHRL
  Gene Name: ghrelin/obestatin prepropeptide
  Uniprot ID: Q9UBU3
  ENSP ID: ENSP00000287656
MPSPGTVCSLLLLGMLWLDLAMAGSSFLSPEHQRVQRKESKKPPAKLQPRALAGWLRPEDGGQAEGAEDELEVRFNAPFDVGIKLSGVQYQQHSQALGKFLQDILWEEAKEAPADK

SEQ ID NO: 34569 - protein, 117 aa, Homo sapiens
  Payload ID: 6823
  Gene Symbol: GHRL
  Gene Name: ghrelin/obestatin prepropeptide
  Uniprot ID: Q9UBU3
  ENSP ID: ENSP00000335074
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 34570 - protein, 104 aa, Homo sapiens
  Payload ID: 6823
  Gene Symbol: GHRL
  Gene Name: ghrelin/obestatin prepropeptide
  Uniprot ID: Q9UBU3
  ENSP ID: ENSP00000388145
MFTCWWSYLRSTLAAVPGEASRVQRKESKKPPAKLQPRALAGWLRPEDGGQAEGAEDELEVRFNAPFDVGIKLSGVQYQQHSQALGKFLQDILWEEAKEAPADK

SEQ ID NO: 34571 - protein, 117 aa, Homo sapiens; identical to SEQ ID NO: 34569
  Payload ID: 6823
  Gene Symbol: GHRL
  Gene Name: ghrelin/obestatin prepropeptide
  Uniprot ID: Q9UBU3
  ENSP ID: ENSP00000391406

SEQ ID NO: 34572 - protein, 40 aa, Homo sapiens
  Payload ID: 6823
  Gene Symbol: GHRL
  Gene Name: ghrelin/obestatin prepropeptide
  ENSP ID: ENSP00000394923
MFTCWWSYLRSTLAAVPGEASRVQRPQPTSDRPQALLTSL

SEQ ID NO: 34573 - protein, 116 aa, Homo sapiens; identical to SEQ ID NO: 34568
  Payload ID: 6823
  Gene Symbol: GHRL
  Gene Name: ghrelin/obestatin prepropeptide
  Uniprot ID: Q9UBU3
  ENSP ID: ENSP00000399922

SEQ ID NO: 34574 - protein, 66 aa, Homo sapiens
  Payload ID: 6823
  Gene Symbol: GHRL
  Gene Name: ghrelin/obestatin prepropeptide
  Uniprot ID: Q9UBU3
  ENSP ID: ENSP00000403725
MFTCWWSYLRSTLAAVPGEASRVQFNAPFDVGIKLSGVQYQQHSQALGKFLQDILWEEAKEAPADK

SEQ ID NO: 34575 - protein, 33 aa, Homo sapiens
  Payload ID: 6823
  Gene Symbol: GHRL
  Gene Name: ghrelin/obestatin prepropeptide
  ENSP ID: ENSP00000405031
MPSPGTVCSLLLLGMLWLDLAMAGSSFLSPEHQ

SEQ ID NO: 34576 - protein, 91 aa, Homo sapiens
  Payload ID: 6823
  Gene Symbol: GHRL
  Gene Name: ghrelin/obestatin prepropeptide
  Uniprot ID: Q9UBU3
  ENSP ID: ENSP00000405464
MPSPGTVCSLLLLGMLWLDLAMAGSSFLSPEHQRVQQRKESKKPPAKLQPRALAGWLRPEDGGQAEGAEDELEVRRPQPTSDRPQALLTSL

SEQ ID NO: 34577 - protein, 117 aa, Homo sapiens; identical to SEQ ID NO: 34569
  Payload ID: 6823
  Gene Symbol: GHRL
  Gene Name: ghrelin/obestatin prepropeptide
  Uniprot ID: Q9UBU3
  ENSP ID: ENSP00000414819

SEQ ID NO: 34578 - protein, 105 aa, Homo sapiens
  Payload ID: 6823
  Gene Symbol: GHRL
  Gene Name: ghrelin/obestatin prepropeptide
  Uniprot ID: Q9UBU3
  ENSP ID: ENSP00000416768
MFTCWWSYLRSTLAAVPGEASRVQQRKESKKPPAKLQPRALAGWLRPEDGGQAEGAEDELEVRFNAPFDVGIKLSGVQYQQHSQALGKFLQDILWEEAKEAPADK

SEQ ID NO: 34579 - protein, 300 aa, Homo sapiens
  Payload ID: 6824
  Gene Symbol: GID4
  Gene Name: GID complex subunit 4 homolog
  Uniprot ID: Q8IVV7
  ENSP ID: ENSP00000268719
MCARGQVGRGTQLRTGRPCSQVPGSRWRPERLLRRQRAGGRPSRPHPARARPGLSLPATLLGSRAAAAVPLPLPPALAPGDPAMPVRTECPPPAGASAASAASLIPPPPINTQQPGVATSLLYSGSKFRGHQKSKGNSYDVEVVLQHVDTGNSYLCGYLKIKGLTEEYPTLTTFFEGEIISKKHPFLTRKWDADEDVDRKHWGKFLAFYQYAKSFNSDDFDYEELKNGDYVFMRWKEQFLVPDHTIKDISGASFAGFYYICFQKSAASIEGYYYHRSSEWYQSLNLTHVPEHSAPIYEFR

SEQ ID NO: 34580 - protein, 309 aa, Homo sapiens
  Payload ID: 6824
  Gene Symbol: GID4
  Gene Name: GID complex subunit 4 homolog
  ENSP ID: ENSP00000365523
MCARGQVGRGTQLRTGRPCSQVPGSRWRPERLLRRQRAGGRPSRPHPARARPGLSLPATLLGSRAAAAVPLPLPPALAPGDPAMPVRTECPPPAGASAASAASLIPPPPINTQQPGVATSLLYSGSKFRGHQKSKGNSYDVEVVLQHVDTGNSYLCGYLKIKGLTEEYPTLTTFFEGEIISKKHPFLTRKWDADEDVDRKHWNIGRYLDLQTLLDWTETFWVREELRRPPLVLACEVWLSQGAEPMECFLLQQFVAAFVVLSISPNFHHSWRTPRFPRGTPGALYCTWVCLRFTMSNTLHLGCHFFIIN

SEQ ID NO: 34581 - protein, 111 aa, Homo sapiens
  Payload ID: 6824
  Gene Symbol: GID4
  Gene Name: GID complex subunit 4 homolog
  ENSP ID: ENSP00000466085
TLTTFFEGEIISKKHPFLTRKWDADEDVDRKHWGKFLAFYQYAKSFNSDDFDYEELKNGDYVFMRWKEQFLVPDHTIKDISGASFAGFYYICFQKSAASIEGYYYHRSSEW

SEQ ID NO: 34582 - protein, 146 aa, Homo sapiens
  Payload ID: 6824
  Gene Symbol: GID4
  Gene Name: GID complex subunit 4 homolog
  ENSP ID: ENSP00000466908
FFEGEIISKKHPFLTRKWDADEDVDRKHWNIGRYLDLQTLLDWTETFWGKFLAFYQYAKSFNSDDFDYEELKNGDYVFMRWKEQFLVPDHTIKDISGASFAGFYYICFQKSAASIEGYYYHRSSEWYQSLNLTHVPEHSAPIYEFR

SEQ ID NO: 34583 - protein, 228 aa, Homo sapiens
  Payload ID: 6825
  Gene Symbol: GID8
  Gene Name: GID complex subunit 8
  Uniprot ID: Q9NWU2
  ENSP ID: ENSP00000266069
MSYAEKPDEITKDEWMEKLNNLHVQRADMNRLIMNYLVTEGFKEAAEKFRMESGIEPSVDLETLDERIKIREMILKGQIQEAIALINSLHPELLDTNRYLYFHLQQQHLIELIRQRETEAALEFAQTQLAEQGEESRECLTEMERTLALLAFDSPEESPFGDLLHTMQRQKVWSEVNQAVLDYENRESTPKLAKLLKLLLWAQNELDQKKVKYPKMTDLSKGVIEEPK

SEQ ID NO: 34584 - protein, 597 aa, Homo sapiens
  Payload ID: 6826
  Gene Symbol: GAN
  Gene Name: gigaxonin
  Uniprot ID: Q9H2C0
  ENSP ID: ENSP00000476795
MAEGSAVSDPQHAARLLRALSSFREESRFCDAHLVLDGEEIPVQKNILAAASPYIRTKLNYNPPKDDGSTYKIELEGISVMVMREILDYIFSGQIRLNEDTIQDVVQAADLLLLTDLKTLCCEFLEGCIAAENCIGIRDFALHYCLHHVHYLATEYLETHFRDVSSTEEFLELSPQKLKEVISLEKLNVGNERYVFEAVIRWIAHDTEIRKVHMKDVMSALWVSGLDSSYLREQMLNEPLVREIVKECSNIPLSQPQQGEAMLANFKPRGYSECIVTVGGEERVSRKPTAAMRCMCPLYDPNRQLWIELAPLSMPRINHGVLSAEGFLFVFGGQDENKQTLSSGEKYDPDANTWTALPPMNEARHNFGIVEIDGMLYILGGEDGEKELISMECYDIYSKTWTKQPDLTMVRKIGCYAAMKKKIYAMGGGSYGKLFESVECYDPRTQQWTAICPLKERRFGAVACGVAMELYVFGGVRSREDAQGSEMVTCKSEFYHDEFKRWIYLNDQNLCIPASSSFVYGAVPIGASIYVIGDLDTGTNYDYVREFKRSTGTWHHTKPLLPSDLRRTGCAALRIANCKLFRLQLQQGLFRIRVHSP

SEQ ID NO: 34585 - protein, 511 aa, Homo sapiens
  Payload ID: 6827
  Gene Symbol: GIMAP1-GIMAP5
  Gene Name: GIMAP1-GIMAP5 readthrough
  ENSP ID: ENSP00000477920
MGGRKMATDEENVYGLEENAQSRQESTRRLILVGRTGAGKSATGNSILGQRRFFSRLGATSVTRACTTGSRRWDKCHVEVVDTPDIFSSQVSKTDPGCEERGHCYLLSAPGPHALLLVTQLGRFTAQDQQAVRQLSHGAFSPSTWLLLNCVCSTSLSPVNSIPAHRRRAGLSLLPLHLPERGPAARASVTATLEDRAQQPFLERMGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 34586 - protein, 196 aa, Homo sapiens
  Payload ID: 6828
  Gene Symbol: GINS1
  Gene Name: GINS complex subunit 1 (Psf1 homolog)
  Uniprot ID: Q14691
  ENSP ID: ENSP00000262460
MFCEKAMELIRELHRAPEGQLPAFNEDGLRQVLEEMKALYEQNQSDVNEAKSGGRSDLIPTIKFRHCSLLRNRRCTVAYLYDRLLRIRALRWEYGSVLPNALRFHMAAEEMEWFNNYKRSLATYMRSLGGDEGLDITQDMKPPKSLYIEVRCLKDYGEFEVDDGTSVLLKKNSQHFLPRWKCEQLIRQGVLEHILS

SEQ ID NO: 34587 - protein, 185 aa, Homo sapiens
  Payload ID: 6829
  Gene Symbol: GINS2
  Gene Name: GINS complex subunit 2 (Psf2 homolog)
  Uniprot ID: Q9Y248
  ENSP ID: ENSP00000253462
MDAAEVEFLAEKELVTIIPNFSLDKIYLIGGDLGPFNPGLPVEVPLWLAINLKQRQKCRLLPPEWMDVEKLEKMRDHERKEETFTPMPSPYYMELTKLLLNHASDNIPKADEIRTLVKDMWDTRIAKLRVSADSFVRQQEAHAKLDNLTLMEINTSGTFLTQALNHMYKLRTNLQPLESTQSQDF

SEQ ID NO: 34588 - protein, 51 aa, Homo sapiens
  Payload ID: 6829
  Gene Symbol: GINS2
  Gene Name: GINS complex subunit 2 (Psf2 homolog)
  ENSP ID: ENSP00000469346
MDVEKLEKMRDHERKEETFTPMPSPYYMELTKLLLNHASDNIPKADEIRTL

SEQ ID NO: 34589 - protein, 69 aa, Homo sapiens
  Payload ID: 6829
  Gene Symbol: GINS2
  Gene Name: GINS complex subunit 2 (Psf2 homolog)
  ENSP ID: ENSP00000470984
MDVEKLEKMRDHERKEETFTPMPSPYYMELTKLLLNHASDNIPKADEIRTLVKDMWDTRIAKLRVSADS

SEQ ID NO: 34590 - protein, 216 aa, Homo sapiens
  Payload ID: 6830
  Gene Symbol: GINS3
  Gene Name: GINS complex subunit 3 (Psf3 homolog)
  Uniprot ID: Q9BRX5
  ENSP ID: ENSP00000318196
MSEAYFRVESGALGPEENFLSLDDILMSHEKLPVRTETAMPRLGAFFLERSAGAETDNAVPQGSKLELPLWLAKGLFDNKRRILSVELPKIYQEGWRTVFSADPNVVDLHKMGPHFYGFGSQLLHFDSPENADISQSLLQTFIGRFRRIMDSSQNAYNEDTSALVARLDEMERGLFQTGQKGLNDFQCWEKGQASQITASNLVQNYKKRKFTDMED

SEQ ID NO: 34591 - protein, 138 aa, Homo sapiens
  Payload ID: 6830
  Gene Symbol: GINS3
  Gene Name: GINS complex subunit 3 (Psf3 homolog)
  Uniprot ID: Q9BRX5
  ENSP ID: ENSP00000327449
MSEAYFRVESGALGPEENFLSLDDILMSHEKLPVRTETAMPRLGAFFLERSAGAETDNAVPQTFIGRFRRIMDSSQNAYNEDTSALVARLDEMERGLFQTGQKGLNDFQCWEKGQASQITASNLVQNYKKRKFTDMED

SEQ ID NO: 34592 - protein, 255 aa, Homo sapiens
  Payload ID: 6830
  Gene Symbol: GINS3
  Gene Name: GINS complex subunit 3 (Psf3 homolog)
  Uniprot ID: Q9BRX5
  ENSP ID: ENSP00000401018
MSEAYFRVESGALGPEENFLSLDDILMSHEKLPVRTETAMPRLGAFFLERSAGAETDNAVPQGFALLPRLECSGVIWLTAALTSQAPEILPPQPPMWLVLQGSKLELPLWLAKGLFDNKRRILSVELPKIYQEGWRTVFSADPNVVDLHKMGPHFYGFGSQLLHFDSPENADISQSLLQTFIGRFRRIMDSSQNAYNEDTSALVARLDEMERGLFQTGQKGLNDFQCWEKGQASQITASNLVQNYKKRKFTDMED

SEQ ID NO: 34593 - protein, 223 aa, Homo sapiens
  Payload ID: 6831
  Gene Symbol: GINS4
  Gene Name: GINS complex subunit 4 (Sld5 homolog)
  Uniprot ID: Q9BRT9
  ENSP ID: ENSP00000276533
MTEEVDFLGQDSDGGSEEVVLTPAELIERLEQAWMNEKFAPELLESKPEIVECVMEQLEHMEENLRRAKREDLKVSIHQMEMERIRYVLSSYLRCRLMKIEKFFPHVLEKEKTRPEGEPSSLSPEELAFAREFMANTESYLKNVALKHMPPNLQKVDLFRAVPKPDLDSYVFLRVRERQENILVEPDTDEQRDYVIDLEKGSQHLIRYKTIAPLVASGAVQLI

SEQ ID NO: 34594 - protein, 223 aa, Homo sapiens; identical to SEQ ID NO: 34593
  Payload ID: 6831
  Gene Symbol: GINS4
  Gene Name: GINS complex subunit 4 (Sld5 homolog)
  Uniprot ID: Q9BRT9
  ENSP ID: ENSP00000428754

SEQ ID NO: 34595 - protein, 192 aa, Homo sapiens
  Payload ID: 6831
  Gene Symbol: GINS4
  Gene Name: GINS complex subunit 4 (Sld5 homolog)
  ENSP ID: ENSP00000428901
MTEEVDFLGQDSDGGSEEVVLTPAELIERLEQAWMNEKFAPELLESKPEIVECVMEQLEHMEENLRRAKREDLKVSIHQMEMERIRYVLSSYLRCRLMKIEKFFPHVLEKEKTRPEGEPSSLSPEELAFAREFMANTESYLKNVALKHMPPNLQKVDLFRAVPKPDLDSYVFLRVRERQENILVEPDTDEQR

SEQ ID NO: 34596 - protein, 100 aa, Homo sapiens
  Payload ID: 6831
  Gene Symbol: GINS4
  Gene Name: GINS complex subunit 4 (Sld5 homolog)
  Uniprot ID: Q9BRT9
  ENSP ID: ENSP00000429581
MTEEVDFLGQDSDGGSEEVVLTPAELIERLEQAWMNEKFAPELLESKPEIVECVMEQLEHMEENLRRAKREDLKVSIHQMEMERIRYVLSSYLRCRLMKV

SEQ ID NO: 34597 - protein, 104 aa, Homo sapiens
  Payload ID: 6831
  Gene Symbol: GINS4
  Gene Name: GINS complex subunit 4 (Sld5 homolog)
  ENSP ID: ENSP00000429894
MTEEVDFLGQDSDGGSEEVVLTPAELIERLEQAWMNEKFAPELLESKPEIVECVMEQLEHMEENLRRAKREDLKVSIHQMEMERIRYVLSSYLRCRLMKFPNQI

SEQ ID NO: 34598 - protein, 333 aa, Homo sapiens
  Payload ID: 6832
  Gene Symbol: GIPC1
  Gene Name: GIPC PDZ domain containing family, member 1
  Uniprot ID: O14908
  ENSP ID: ENSP00000340698
MPLGLGRRKKAPPLVENEEAEPGRGGLGVGEPGPLGGGGSGGPQMGLPPPPPALRPRLVFHTQLAHGSPTGRIEGFTNVKELYGKIAEAFRLPTAEVMFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 34599 - protein, 236 aa, Homo sapiens
  Payload ID: 6832
  Gene Symbol: GIPC1
  Gene Name: GIPC PDZ domain containing family, member 1
  Uniprot ID: O14908
  ENSP ID: ENSP00000376748
MFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 34600 - protein, 333 aa, Homo sapiens; identical to SEQ ID NO: 34598
  Payload ID: 6832
  Gene Symbol: GIPC1
  Gene Name: GIPC PDZ domain containing family, member 1
  Uniprot ID: O14908
  ENSP ID: ENSP00000376753

SEQ ID NO: 34601 - protein, 121 aa, Homo sapiens
  Payload ID: 6832
  Gene Symbol: GIPC1
  Gene Name: GIPC PDZ domain containing family, member 1
  ENSP ID: ENSP00000464879
MFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAF

SEQ ID NO: 34602 - protein, 62 aa, Homo sapiens
  Payload ID: 6832
  Gene Symbol: GIPC1
  Gene Name: GIPC PDZ domain containing family, member 1
  ENSP ID: ENSP00000465003
MFCTLNTHKVDMDKLLGGQIGLEDFIFAHVKGQRKEVEVFKSEDALGLTITDNGAGYAFIKT

SEQ ID NO: 34603 - protein, 40 aa, Homo sapiens
  Payload ID: 6832
  Gene Symbol: GIPC1
  Gene Name: GIPC PDZ domain containing family, member 1
  ENSP ID: ENSP00000466105
MPLGLGRRKKAPPLVENEEAEPGRGGLGVGEPGPLGGGGS

SEQ ID NO: 34604 - protein, 128 aa, Homo sapiens
  Payload ID: 6832
  Gene Symbol: GIPC1
  Gene Name: GIPC PDZ domain containing family, member 1
  ENSP ID: ENSP00000466312
KRRRTQAAGDSGWDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 34605 - protein, 40 aa, Homo sapiens; identical to SEQ ID NO: 34603
  Payload ID: 6832
  Gene Symbol: GIPC1
  Gene Name: GIPC PDZ domain containing family, member 1
  ENSP ID: ENSP00000466624

SEQ ID NO: 34606 - protein, 333 aa, Homo sapiens; identical to SEQ ID NO: 34598
  Payload ID: 6832
  Gene Symbol: GIPC1
  Gene Name: GIPC PDZ domain containing family, member 1
  Uniprot ID: O14908
  ENSP ID: ENSP00000466747

SEQ ID NO: 34607 - protein, 236 aa, Homo sapiens; identical to SEQ ID NO: 34599
  Payload ID: 6832
  Gene Symbol: GIPC1
  Gene Name: GIPC PDZ domain containing family, member 1
  Uniprot ID: O14908
  ENSP ID: ENSP00000467077

SEQ ID NO: 34608 - protein, 159 aa, Homo sapiens
  Payload ID: 6832
  Gene Symbol: GIPC1
  Gene Name: GIPC PDZ domain containing family, member 1
  ENSP ID: ENSP00000468787
MFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDL

SEQ ID NO: 34609 - protein, 315 aa, Homo sapiens
  Payload ID: 6833
  Gene Symbol: GIPC2
  Gene Name: GIPC PDZ domain containing family, member 2
  Uniprot ID: Q8TF65
  ENSP ID: ENSP00000359795
MPLKLRGKKKAKSKETAGLVEGEPTGAGGGSLSASRAPARRLVFHAQLAHGSATGRVEGFSSIQELYAQIAGAFEISPSEILYCTLNTPKIDMERLLGGQLGLEDFIFAHVKGIEKEVNVYKSEDSLGLTITDNGVGYAFIKRIKDGGVIDSVKTICVGDHIESINGENIVGWRHYDVAKKLKELKKEELFTMKLIEPKKAFEIELRSKAGKSSGEKIGCGRATLRLRSKGPATVEEMPSETKAKAIEKIDDVLELYMGIRDIDLATTMFEAGKDKVNPDEFAVALDETLGDFAFPDEFVFDVWGVIGDAKRRGL

SEQ ID NO: 34610 - protein, 312 aa, Homo sapiens
  Payload ID: 6834
  Gene Symbol: GIPC3
  Gene Name: GIPC PDZ domain containing family, member 3
  Uniprot ID: Q8TF64
  ENSP ID: ENSP00000319254
MEGAAAREARGTETPRASAPPPAPSEPPAAPRARPRLVFRTQLAHGSPTGKIEGFTNVRELYAKIAEAFGIAPTEILFCTLNSHKVDMQKLLGGQIGLEDFIFAHVRGETKEVEVTKTEDALGLTITDNGAGYAFIKRIKEGSIINRIEAVCVGDSIEAINDHSIVGCRHYEVAKMLRELPKSQPFTLRLVQPKRAFDMIGQRSRSSKCPVEAKVTSGRETLRLRSGGAATVEEAPSEFEEEASRKVDDLLESYMGIRDPELASTMVETSKKTASAQEFARCLDSVLGEFAFPDEFVVEVWAAIGEAREACG

SEQ ID NO: 34611 - protein, 698 aa, Homo sapiens
  Payload ID: 6835
  Gene Symbol: GLE1
  Gene Name: GLE1 RNA export mediator
  Uniprot ID: Q53GS7
  ENSP ID: ENSP00000308622
MPSEGRCWETLKALRSSDKGRLCYYRDWLLRREDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRIEAITSSGQMGSFIRLKQFLEKCLQHKDIPVPKGFLTSSFWRS

SEQ ID NO: 34612 - protein, 659 aa, Homo sapiens
  Payload ID: 6835
  Gene Symbol: GLE1
  Gene Name: GLE1 RNA export mediator
  Uniprot ID: Q53GS7
  ENSP ID: ENSP00000361856
MPSEGRCWETLKALRSSDKGRLCYYRDWLLRREDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRYQAC

SEQ ID NO: 34613 - protein, 1106 aa, Homo sapiens
  Payload ID: 6836
  Gene Symbol: GLI1
  Gene Name: GLI family zinc finger 1
  Uniprot ID: P08151
  ENSP ID: ENSP00000228682
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 34614 - protein, 1065 aa, Homo sapiens
  Payload ID: 6836
  Gene Symbol: GLI1
  Gene Name: GLI family zinc finger 1
  Uniprot ID: P08151
  ENSP ID: ENSP00000434408
MFNSMTPPPISSYGEPCCLRPLPSQGAPSVGTEVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 34615 - protein, 129 aa, Homo sapiens
  Payload ID: 6836
  Gene Symbol: GLI1
  Gene Name: GLI family zinc finger 1
  ENSP ID: ENSP00000434421
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTM

SEQ ID NO: 34616 - protein, 175 aa, Homo sapiens
  Payload ID: 6836
  Gene Symbol: GLI1
  Gene Name: GLI family zinc finger 1
  ENSP ID: ENSP00000436671
MSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKC

SEQ ID NO: 34617 - protein, 978 aa, Homo sapiens
  Payload ID: 6836
  Gene Symbol: GLI1
  Gene Name: GLI family zinc finger 1
  Uniprot ID: P08151
  ENSP ID: ENSP00000437607
MSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 34618 - protein, 1065 aa, Homo sapiens; identical to SEQ ID NO: 34614
  Payload ID: 6836
  Gene Symbol: GLI1
  Gene Name: GLI family zinc finger 1
  Uniprot ID: P08151
  ENSP ID: ENSP00000441006

SEQ ID NO: 34619 - protein, 522 aa, Homo sapiens
  Payload ID: 6837
  Gene Symbol: GLI2
  Gene Name: GLI family zinc finger 2
  ENSP ID: ENSP00000312694
MALTSINATPTQLSSSSNCLSDTNQNKQSSESAVSSTVNPVAIHKRSKVKTEPEGLRPASPLALTQGQVLDTAHVGVPFPSPEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRTPSCLPPGKWLHPGKLQWQWGRRARGAAAEPAAVGAVRERGDHAEPAAGAPRQLHQHGQLGLHREPPLLRHLPLLLQPPLQRGLAPGRRPPAQRELR

SEQ ID NO: 34620 - protein, 67 aa, Homo sapiens
  Payload ID: 6837
  Gene Symbol: GLI2
  Gene Name: GLI family zinc finger 2
  ENSP ID: ENSP00000344473
METSASATASEKQEAKSGILEAAGFPDPGKKASPLVVAAAAAAAVAAQGAQPSPSPTPSTPWPTSRF

SEQ ID NO: 34621 - protein, 1586 aa, Homo sapiens
  Payload ID: 6837
  Gene Symbol: GLI2
  Gene Name: GLI family zinc finger 2
  Uniprot ID: P10070
  ENSP ID: ENSP00000354586
METSASATASEKQEAKSGILEAAGFPDPGKKASPLVVAAAAAAAVAAQGVPQHLLPPFHAPLPIDMRHQEGRYHYEPHSVHGVHGPPALSGSPVISDISLIRLSPHPAGPGESPFNAPHPYVNPHMEHYLRSVHSSPTLSMISAARGLSPADVAQEHLKERGLFGLPAPGTTPSDYYHQMTLVAGHPAPYGDLLMQSGGAASAPHLHDYLNPVDVSRFSSPRVTPRLSRKRALSISPLSDASLDLQRMIRTSPNSLVAYINNSRSSSAASGSYGHLSAGALSPAFTFPHPINPVAYQQILSQQRGLGSAFGHTPPLIQPSPTFLAQQPMALTSINATPTQLSSSSNCLSDTNQNKQSSESAVSSTVNPVAIHKRSKVKTEPEGLRPASPLALTQGQVSGHGSCGCALPLSQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAPERTLPAGCPRPLGPRRGSDGPTYGHGHAGAAPAFPHEAPGGGARRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEVSSGTVDALASQVKPPPFPQGNLAVVQQKPAFGQYPGYSPQGLQASPGGLDSTQPHLQPRSGAPSQGIPRVNYMQQLRQPVAGSQCPGMTTTMSPHACYGQVHPQLSPSTISGALNQFPQSCSNMPAKPGHLGHPQQTEVAPDPTTMGNRHRELGVPDSALAGVPPPHPVQSYPQQSHHLAASMSQEGYHQVPSLLPARQPGFMEPQTGPMGVATAGFGLVQPRPPLEPSPTGRHRGVRAVQQQLAYARATGHAMAAMPSSQETAEAVPKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLFSGALSPSLLHSLSQNSSRLTTPRNSLTLPSIPAGISNMAVGDMSSMLTSLAEESKFLNMMT

SEQ ID NO: 34622 - protein, 1586 aa, Homo sapiens; identical to SEQ ID NO: 34621
  Payload ID: 6837
  Gene Symbol: GLI2
  Gene Name: GLI family zinc finger 2
  Uniprot ID: P10070
  ENSP ID: ENSP00000390436

SEQ ID NO: 34623 - protein, 67 aa, Homo sapiens; identical to SEQ ID NO: 34620
  Payload ID: 6837
  Gene Symbol: GLI2
  Gene Name: GLI family zinc finger 2
  ENSP ID: ENSP00000397488

SEQ ID NO: 34624 - protein, 82 aa, Homo sapiens
  Payload ID: 6837
  Gene Symbol: GLI2
  Gene Name: GLI family zinc finger 2
  ENSP ID: ENSP00000398992
METSASATASEKQEAKSGILEAAGFPDPGKKASPLVVAAAAAAAVAAQGVPQHLLPPFHAPLPIDMRHQEGRYHYEPHSVHG

SEQ ID NO: 34625 - protein, 67 aa, Homo sapiens; identical to SEQ ID NO: 34620
  Payload ID: 6837
  Gene Symbol: GLI2
  Gene Name: GLI family zinc finger 2
  ENSP ID: ENSP00000400593

SEQ ID NO: 34626 - protein, 56 aa, Homo sapiens
  Payload ID: 6837
  Gene Symbol: GLI2
  Gene Name: GLI family zinc finger 2
  ENSP ID: ENSP00000402383
ASEKQEAKSGILEAAGFPDPGKKASPLVVAAAAAAAVAAQGGPLPSAAALSSLTSP

SEQ ID NO: 34627 - protein, 67 aa, Homo sapiens; identical to SEQ ID NO: 34620
  Payload ID: 6837
  Gene Symbol: GLI2
  Gene Name: GLI family zinc finger 2
  ENSP ID: ENSP00000403715

SEQ ID NO: 34628 - protein, 67 aa, Homo sapiens; identical to SEQ ID NO: 34620
  Payload ID: 6837
  Gene Symbol: GLI2
  Gene Name: GLI family zinc finger 2
  ENSP ID: ENSP00000415773

SEQ ID NO: 34629 - protein, 176 aa, Homo sapiens
  Payload ID: 6837
  Gene Symbol: GLI2
  Gene Name: GLI family zinc finger 2
  ENSP ID: ENSP00000441454
ASEKQEAKSGILEAAGFPDPGKKASPLVVAAAAAAAVAAQGVPQHLLPPFHAPLPIDMRHQEGRYHYEPHSVHGVHGVPFLQPAGDAPPEPQAGAVHLPTLRRQPGPAADDPHLTQLASGLHQQLPKQLGGQRFLRASVSGCPQPSLHLPPPHQPRGLPADSEPAEGSGVSLWTHT

SEQ ID NO: 34630 - protein, 1580 aa, Homo sapiens
  Payload ID: 6838
  Gene Symbol: GLI3
  Gene Name: GLI family zinc finger 3
  Uniprot ID: P10071
  ENSP ID: ENSP00000379258
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHRNPTAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDAPGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGQGYLAHQLLGDSMQHPGAGRPGQQMLGQISATSHINIYQGPESCLPGAHGMGSQPSSLAVVRGYQPCASFGGSRRQAMPRDSLALQSGQLSDTSQTCRVNGIKMEMKGQPHPLCSNLQNYSGQFYDQTVGFSQQDTKAGSFSISDASCLLQGTSAKNSELLSPGANQVTSTVDSLDSHDLEGVQIDFDAIIDDGDHSSLMSGALSPSIIQNLSHSSSRLTTPRASLPFPALSMSTTNMAIGDMSSLLTSLAEESKFLAVMQ

SEQ ID NO: 34631 - protein, 180 aa, Homo sapiens
  Payload ID: 6838
  Gene Symbol: GLI3
  Gene Name: GLI family zinc finger 3
  ENSP ID: ENSP00000406135
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHR

SEQ ID NO: 34632 - protein, 96 aa, Homo sapiens
  Payload ID: 6838
  Gene Symbol: GLI3
  Gene Name: GLI family zinc finger 3
  ENSP ID: ENSP00000407963
MEAQSHSSTTTEKKKVENSIVKCSTRTDVSEKAVASSTTSNGNHLEAQARGWTRRIGCIRAVHPCCCTNDSATDPLGWATLKGGSSKECVQTHTFT

SEQ ID NO: 34633 - protein, 76 aa, Homo sapiens
  Payload ID: 6839
  Gene Symbol: GLI4
  Gene Name: GLI family zinc finger 4
  ENSP ID: ENSP00000344727
MAALGDIQESPSVPSPVSLSSPGTPGTQHHEPQLHLHGHQHGSPGSSPKVLSQPSDLDLQDVEEVEIGRDTFWPGE

SEQ ID NO: 34634 - protein, 376 aa, Homo sapiens
  Payload ID: 6839
  Gene Symbol: GLI4
  Gene Name: GLI family zinc finger 4
  Uniprot ID: P10075
  ENSP ID: ENSP00000345024
MAALGDIQESPSVPSPVSLSSPGTPGTQHHEPQLHLHGHQHGSPGSSPKVLSQPSDLDLQDVEEVEIGRDTFWPDSEPKPEQAPRSPGSQAPDEGAGGALRSLLRSLPRRARCSAGFGPESSAERPAGQPPGAVPCAQPRGAWRVTLVQQAAAGPEGAPERAAELGVNFGRSRQGSARGAKPHRCEACGKSFKYNSLLLKHQRIHTGEKPYACHECGKRFRGWSGFIQHHRIHTGEKPYECGQCGRAFSHSSHFTQHLRIHNGEKPYKCGECGQAFSQSSNLVRHQRLHTGEKPYACSQCGKAFIWSSVLIEHQRIHTGEKPYECSDCGKAFRGRSHFFRHLRTHTGEKPFACGACGKAFGQSSQLIQHQRVHYRE

SEQ ID NO: 34635 - protein, 111 aa, Homo sapiens
  Payload ID: 6839
  Gene Symbol: GLI4
  Gene Name: GLI family zinc finger 4
  ENSP ID: ENSP00000427881
MAALGDIQESPSVPSPVSLSSPGTPGTQHHEPQLHLHGHQHGSPGSSPKVLSQPSDLDLQDVEEVEIGRDTFWPDGLPSAWLELCPGPLHLPLEKLPGFPLGDVSDMAGFN

SEQ ID NO: 34636 - protein, 56 aa, Homo sapiens
  Payload ID: 6839
  Gene Symbol: GLI4
  Gene Name: GLI family zinc finger 4
  ENSP ID: ENSP00000429295
MAALGDIQESPSVPSPVSLSSPGTPGTQHHEPQLHLHGHQHALRCSPSRPTWISKT

SEQ ID NO: 34637 - protein, 86 aa, Homo sapiens
  Payload ID: 6839
  Gene Symbol: GLI4
  Gene Name: GLI family zinc finger 4
  ENSP ID: ENSP00000429514
TPGTQHHEPQLHLHGHQHGSPGSSPKVLSQPSDLDLQDVEEVEIGRDTFWPGPGAAPASGLNPARSGRRASRLGPSLAPSRGAPGA

SEQ ID NO: 34638 - protein, 165 aa, Homo sapiens
  Payload ID: 6839
  Gene Symbol: GLI4
  Gene Name: GLI family zinc finger 4
  ENSP ID: ENSP00000430292
MAALGDIQESPSVPSPVSLSSPGTPGTQHHEPQLHLHGHQHGSPGSSPKVLSQPSDLDLQDVEEVEIGRDTFWPVQLLMLPEAVTAAHSHLRQWPHVDSCRPQLDTVNQELLPPLHLPWAGASGSGHHCPPRSTSYPVSPPPPASPRWPPLSLVGAVSRSPAPPP

SEQ ID NO: 34639 - protein, 376 aa, Homo sapiens; identical to SEQ ID NO: 34634
  Payload ID: 6839
  Gene Symbol: GLI4
  Gene Name: GLI family zinc finger 4
  Uniprot ID: P10075
  ENSP ID: ENSP00000430987

SEQ ID NO: 34640 - protein, 266 aa, Homo sapiens
  Payload ID: 6840
  Gene Symbol: GLIPR1
  Gene Name: GLI pathogenesis-related 1
  Uniprot ID: P48060
  ENSP ID: ENSP00000266659
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNRYTSLFLIVNSVILILSVIITILVQHKYPNLVLLD

SEQ ID NO: 34641 - protein, 238 aa, Homo sapiens
  Payload ID: 6840
  Gene Symbol: GLIPR1
  Gene Name: GLI pathogenesis-related 1
  ENSP ID: ENSP00000391144
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVSQERGRDPNPKRGFLNLARENPGLFGQIVTKLAAQFNFALKFLALTLFPMEHILYATTDQEGITQLGHIREEPPAVPAPIMTSVWTISVLTDSETKS

SEQ ID NO: 34642 - protein, 148 aa, Homo sapiens
  Payload ID: 6840
  Gene Symbol: GLIPR1
  Gene Name: GLI pathogenesis-related 1
  ENSP ID: ENSP00000440595
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQRELPNLAI

SEQ ID NO: 34643 - protein, 89 aa, Homo sapiens
  Payload ID: 6840
  Gene Symbol: GLIPR1
  Gene Name: GLI pathogenesis-related 1
  ENSP ID: ENSP00000448008
MTKSRTMTSRLGYAKKSVATTLRLFGQIVTKLAAQFNFALKFLALTLFPMEHILYATTDQEGITQLGHIREEPPAVPAPIMTSVWTISV

SEQ ID NO: 34644 - protein, 233 aa, Homo sapiens
  Payload ID: 6841
  Gene Symbol: GLIPR1L1
  Gene Name: GLI pathogenesis-related 1 like 1
  Uniprot ID: Q6UWM5
  ENSP ID: ENSP00000310770
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCKNPFLKPTGRAPQQTAFNPFSLGFLLLRIF

SEQ ID NO: 34645 - protein, 242 aa, Homo sapiens
  Payload ID: 6841
  Gene Symbol: GLIPR1L1
  Gene Name: GLI pathogenesis-related 1 like 1
  Uniprot ID: Q6UWM5
  ENSP ID: ENSP00000367967
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCRTPQLIIPNQNPFLKPTGRAPQQTAFNPFSLGFLLLRIF

SEQ ID NO: 34646 - protein, 39 aa, Homo sapiens
  Payload ID: 6841
  Gene Symbol: GLIPR1L1
  Gene Name: GLI pathogenesis-related 1 like 1
  ENSP ID: ENSP00000450311
  MOD_RES (1)..(1): Any amino acid
XLSPQSPKGQLAACSNKMSFLFRAEEGLHNLLYLTKIHF

SEQ ID NO: 34647 - protein, 57 aa, Homo sapiens
  Payload ID: 6841
  Gene Symbol: GLIPR1L1
  Gene Name: GLI pathogenesis-related 1 like 1
  ENSP ID: ENSP00000487263
MSLLKLILLRVPCRATACQKGLTTQTFPLSPQSPKGQLAACSNKMSFLFRAEEKIHF

SEQ ID NO: 34648 - protein, 253 aa, Homo sapiens
  Payload ID: 6842
  Gene Symbol: GLIPR1L2
  Gene Name: GLI pathogenesis-related 1 like 2
  Uniprot ID: Q4G1C9
  ENSP ID: ENSP00000317385
MEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSKIKKINMKKMHNGLDKKNKRLNTSFLWSC

SEQ ID NO: 34649 - protein, 237 aa, Homo sapiens
  Payload ID: 6842
  Gene Symbol: GLIPR1L2
  Gene Name: GLI pathogenesis-related 1 like 2
  Uniprot ID: Q4G1C9
  ENSP ID: ENSP00000367963
MVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSNADRDQATYYRFWYPKWEMPRPVVCDPLCTFILLLRILCFILCVITVLIVQSQFPNILLEQQMIFTPEESEAGNEEEEKEEEKKEKEEMEMEIMEMEEEKEEREEEEEETQKEKMEEEEK

SEQ ID NO: 34650 - protein, 168 aa, Homo sapiens
  Payload ID: 6842
  Gene Symbol: GLIPR1L2
  Gene Name: GLI pathogenesis-related 1 like 2
  Uniprot ID: Q4G1C9
  ENSP ID: ENSP00000447980
MEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQRNTDEKTL

SEQ ID NO: 34651 - protein, 344 aa, Homo sapiens
  Payload ID: 6842
  Gene Symbol: GLIPR1L2
  Gene Name: GLI pathogenesis-related 1 like 2
  Uniprot ID: Q4G1C9
  ENSP ID: ENSP00000448248
MEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSNADRDQATYYRFWYPKWEMPRPVVCDPLCTFILLLRILCFILCVITVLIVQSQFPNILLEQQMIFTPEESEAGNEEEEKEEEKKEKEEMEMEIMEMEEEKEEREEEEEETQKEKMEEEEK

SEQ ID NO: 34652 - protein, 128 aa, Homo sapiens
  Payload ID: 6843
  Gene Symbol: GLIPR2
  Gene Name: GLI pathogenesis-related 2
  ENSP ID: ENSP00000367195
MGKSASKQFHNEVLKAHNEYRQKHGVPPLKLCKNLNREAQQYSEALASTRILKHSPESSRGQCGENLAWASYDQTGHFTAMVWKNTKKMGVGKASASDGSSFVVARYFPAGNVVNEGFFEENVLPPKK

SEQ ID NO: 34653 - protein, 154 aa, Homo sapiens
  Payload ID: 6843
  Gene Symbol: GLIPR2
  Gene Name: GLI pathogenesis-related 2
  Uniprot ID: Q9H4G4
  ENSP ID: ENSP00000367196
MGKSASKQFHNEVLKAHNEYRQKHGVPPLKLCKNLNREAQQYSEALASTRILKHSPESSRGQCGENLAWASYDQTGKEVADRWYSEIKNYNFQQPGFTSGTGHFTAMVWKNTKKMGVGKASASDGSSFVVARYFPAGNVVNEGFFEENVLPPKK

SEQ ID NO: 34654 - protein, 62 aa, Homo sapiens
  Payload ID: 6843
  Gene Symbol: GLIPR2
  Gene Name: GLI pathogenesis-related 2
  ENSP ID: ENSP00000379857
MGKSASKQFHNEVLKAHNEYRQKHGVPPLKLCKNLNREAQQTLHGHGMEEHQEDGRGEGVRK

SEQ ID NO: 34655 - protein, 72 aa, Homo sapiens
  Payload ID: 6843
  Gene Symbol: GLIPR2
  Gene Name: GLI pathogenesis-related 2
  ENSP ID: ENSP00000478768
MVRNPALPDLAVSLVRRKPGHFTAMVWKNTKKMGVGKASASDGSSFVVARYFPAGNVVNEGFFEENVLPPKK

SEQ ID NO: 34656 - protein, 142 aa, Homo sapiens
  Payload ID: 6844
  Gene Symbol: GMFB
  Gene Name: glia maturation factor, beta
  Uniprot ID: P60983
  ENSP ID: ENSP00000350757
MSESLVVCDVAEDLVEKLRKFRFRKETNNAAIIMKIDKDKRLVVLDEELEGISPDELKDELPERQPRFIVYSYKYQHDDGRVSYPLCFIFSSPVGCKPEQQMMYAGSKNKLVQTAELTKVFEIRNTEDLTEEWLREKLGFFH

SEQ ID NO: 34657 - protein, 38 aa, Homo sapiens
  Payload ID: 6844
  Gene Symbol: GMFB
  Gene Name: glia maturation factor, beta
  ENSP ID: ENSP00000451473
MSESLVVCDVAEDLVEKLRKFRFRKETNNAAIIRHFTR

SEQ ID NO: 34658 - protein, 150 aa, Homo sapiens
  Payload ID: 6844
  Gene Symbol: GMFB
  Gene Name: glia maturation factor, beta
  ENSP ID: ENSP00000451920
MNKFVGLSNVDPKSESLVVCDVAEDLVEKLRKFRFRKETNNAAIIMKIDKDKRLVVLDEELEGISPDELKDELPERQPRTFIVYSYKYQHDDGRVSYPLCFIFSSPVGCKPEQQMMYAGSKNKLVQTAELTKVFEIRNTEDLTEEWLREK

SEQ ID NO: 34659 - protein, 38 aa, Homo sapiens; identical to SEQ ID NO: 34657
  Payload ID: 6844
  Gene Symbol: GMFB
  Gene Name: glia maturation factor, beta
  ENSP ID: ENSP00000452410

SEQ ID NO: 34660 - protein, 142 aa, Homo sapiens; identical to SEQ ID NO: 34656
  Payload ID: 6844
  Gene Symbol: GMFB
  Gene Name: glia maturation factor, beta
  Uniprot ID: P60983
  ENSP ID: ENSP00000479543

SEQ ID NO: 34661 - protein, 38 aa, Homo sapiens; identical to SEQ ID NO: 34657
  Payload ID: 6844
  Gene Symbol: GMFB
  Gene Name: glia maturation factor, beta
  ENSP ID: ENSP00000487065

SEQ ID NO: 34662 - protein, 109 aa, Homo sapiens
  Payload ID: 6845
  Gene Symbol: GMFG
  Gene Name: glia maturation factor, gamma
  ENSP ID: ENSP00000253054
MKVDKDRQMVVLEEEFQNISPEELKMELPERQPRFVVYSYKYVHDDGRVSYPLCFIFSSPVGCKPEQQMMYAGSKNRLVQTAELTKVFEIRTTDDLTEAWLQEKLSFFR

SEQ ID NO: 34663 - protein, 73 aa, Homo sapiens
  Payload ID: 6845
  Gene Symbol: GMFG
  Gene Name: glia maturation factor, gamma
  ENSP ID: ENSP00000468894
MSDSLVVCEVDPELTEKLRKFRFRKETDNAAIIMKVDKDRQMVVLEEEFQVFEIRTTDDLTEAWLQEKLSFFR

SEQ ID NO: 34664 - protein, 79 aa, Homo sapiens
  Payload ID: 6845
  Gene Symbol: GMFG
  Gene Name: glia maturation factor, gamma
  ENSP ID: ENSP00000469050
MSDSLVVCEVDPELTEKLRKFRFRKETDNAAIIMKVDKDRQMVVLEEEFQNISPEELKMELPERQPRLQAGTTDDVCRE

SEQ ID NO: 34665 - protein, 59 aa, Homo sapiens
  Payload ID: 6845
  Gene Symbol: GMFG
  Gene Name: glia maturation factor, gamma
  ENSP ID: ENSP00000469485
SDSLVVCEVDPELTEKLRKFRFRKETDNAAIIKHFPRGAQNGVAGETAQVRGLQLQVRA

SEQ ID NO: 34666 - protein, 11 aa, Homo sapiens
  Payload ID: 6845
  Gene Symbol: GMFG
  Gene Name: glia maturation factor, gamma
  ENSP ID: ENSP00000469755
MVRGLQLQVRA

SEQ ID NO: 34667 - protein, 93 aa, Homo sapiens
  Payload ID: 6845
  Gene Symbol: GMFG
  Gene Name: glia maturation factor, gamma
  ENSP ID: ENSP00000469813
MNISPEELKMELPERQPRFVVYSYKYVHDDGRVSYPLCFIFSSPVGCKPEQQMMYAGSKNRLVQTAELTKVFEIRTTDDLTEAWLQEKLSFFR

SEQ ID NO: 34668 - protein, 138 aa, Homo sapiens
  Payload ID: 6845
  Gene Symbol: GMFG
  Gene Name: glia maturation factor, gamma
  ENSP ID: ENSP00000469877
MSDSLVVCEVDPELTEKLRKFRFRKETDNAAIIMKVDKDRQMVVLEEEFQNISPEELKMELPERQPRFVVYSYKYVHDDGRVSYPLCFIFSSPVGCKPEQQMMYAGSKNRLVQTAELTKVQTGMGLQSVRERWCGSWV

SEQ ID NO: 34669 - protein, 109 aa, Homo sapiens; identical to SEQ ID NO: 34662
  Payload ID: 6845
  Gene Symbol: GMFG
  Gene Name: glia maturation factor, gamma
  ENSP ID: ENSP00000471139

SEQ ID NO: 34670 - protein, 101 aa, Homo sapiens
  Payload ID: 6845
  Gene Symbol: GMFG
  Gene Name: glia maturation factor, gamma
  ENSP ID: ENSP00000471786
MVVLEEEFQNISPEELKMELPERQPRFVVYSYKYVHDDGRVSYPLCFIFSSPVGCKPEQQMMYAGSKNRLVQTAELTKVFEIRTTDDLTEAWLQEKLSFFR

SEQ ID NO: 34671 - protein, 142 aa, Homo sapiens
  Payload ID: 6845
  Gene Symbol: GMFG
  Gene Name: glia maturation factor, gamma
  Uniprot ID: O60234
  ENSP ID: ENSP00000472249
MSDSLVVCEVDPELTEKLRKFRFRKETDNAAIIMKVDKDRQMVVLEEEFQNISPEELKMELPERQPRFVVYSYKYVHDDGRVSYPLCFIFSSPVGCKPEQQMMYAGSKNRLVQTAELTKVFEIRTTDDLTEAWLQEKLSFFR

SEQ ID NO: 34672 - protein, 60 aa, Homo sapiens
  Payload ID: 6845
  Gene Symbol: GMFG
  Gene Name: glia maturation factor, gamma
  ENSP ID: ENSP00000472707
MSDSLVVCEVDPELTEKLRKFRFRKETDNAAIIKHFPRGAQNGVAGETAQVRGLQLQVRA

SEQ ID NO: 34673 - protein, 211 aa, Homo sapiens
  Payload ID: 6846
  Gene Symbol: GDNF
  Gene Name: glial cell derived neurotrophic factor
  Uniprot ID: P39905
  ENSP ID: ENSP00000317145
MKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 34674 - protein, 185 aa, Homo sapiens
  Payload ID: 6846
  Gene Symbol: GDNF
  Gene Name: glial cell derived neurotrophic factor
  Uniprot ID: P39905
  ENSP ID: ENSP00000339703
MKLWDVVAVCLVLLHTASAFPLPAANMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 34675 - protein, 202 aa, Homo sapiens
  Payload ID: 6846
  Gene Symbol: GDNF
  Gene Name: glial cell derived neurotrophic factor
  Uniprot ID: P39905
  ENSP ID: ENSP00000371248
MQSLPNSNGAAAGRDFKMKLWDVVAVCLVLLHTASAFPLPAANMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 34676 - protein, 228 aa, Homo sapiens
  Payload ID: 6846
  Gene Symbol: GDNF
  Gene Name: glial cell derived neurotrophic factor
  Uniprot ID: P39905
  ENSP ID: ENSP00000409007
MQSLPNSNGAAAGRDFKMKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 34677 - protein, 61 aa, Homo sapiens
  Payload ID: 6846
  Gene Symbol: GDNF
  Gene Name: glial cell derived neurotrophic factor
  ENSP ID: ENSP00000423557
MKLWDVVAVCLVLLHTASAFPLPAANMPEDYPDQFDDVMDFIQATIKRLKRSPDKQMAVLP

SEQ ID NO: 34678 - protein, 61 aa, Homo sapiens; identical to SEQ ID NO: 34677
  Payload ID: 6846
  Gene Symbol: GDNF
  Gene Name: glial cell derived neurotrophic factor
  ENSP ID: ENSP00000424592

SEQ ID NO: 34679 - protein, 185 aa, Homo sapiens; identical to SEQ ID NO: 34674
  Payload ID: 6846
  Gene Symbol: GDNF
  Gene Name: glial cell derived neurotrophic factor
  Uniprot ID: P39905
  ENSP ID: ENSP00000425928

SEQ ID NO: 34680 - protein, 159 aa, Homo sapiens
  Payload ID: 6846
  Gene Symbol: GDNF
  Gene Name: glial cell derived neurotrophic factor
  Uniprot ID: P39905
  ENSP ID: ENSP00000478722
MPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 34681 - protein, 436 aa, Homo sapiens
  Payload ID: 6847
  Gene Symbol: GCM1
  Gene Name: glial cells missing homolog 1 (Drosophila)
  Uniprot ID: Q9NP62
  ENSP ID: ENSP00000259803
MEPDDFDSEDKEILSWDINDVKLPQNVKKTDWFQEWPDSYAKHIYSSEDKNAQRHLSSWAMRNTNNHNSRILKKSCLGVVVCGRDCLAEEGRKIYLRPAICDKARQKQQRKRCPNCDGPLKLIPCRGHGGFPVTNFWRHDGRFIFFQSKGEHDHPKPETKLEAEARRAMKKVNTAPSSVSLSLKGSTETRSLPGETQSQGSLPLTWSFQEGVQLPGSYSGHLIANTPQQNSLNDCFSFSKSYGLGGITDLTDQTSTVDPMKLYEKRKLSSSRTYSSGDLLPPSASGVYSDHGDLQAWSKNAALGRNHLADNCYSNYPFPLTSWPCSFSPSQNSSEPFYQQLPLEPPAAKTGCPPLWPNPAGNLYEEKVHVDFNSYVQSPAYHSPQEDPFLFTYASHPHQQYSLPSKSSKWDFEEEMTYLGLDHCNNDMLLNLCPLR

SEQ ID NO: 34682 - protein, 506 aa, Homo sapiens
  Payload ID: 6848
  Gene Symbol: GCM2
  Gene Name: glial cells missing homolog 2 (Drosophila)
  Uniprot ID: O75603
  ENSP ID: ENSP00000368805
MPAAAVQEAVGVCSYGMQLSWDINDPQMPQELALFDQFREWPDGYVRFIYSSDEKKAQRHLSGWAMRNTNNHNGHILKKSCLGVVVCTQACTLPDGSRLQLRPAICDKARLKQQKKACPNCHSALELIPCRGHSGYPVTNFWRLDGNAIFFQAKGVHDHPRPESKSETEARRSAIKRQMASFYQPQKKRIRESEAEENQDSSGHFSNIPPLENPEDFDIVTETSFPIPGQPCPSFPKSDVYKATCDLATFQGDKMPPFQKYSSPRIYLPRPPCSYELANPGYTNSSPYPTLYKDSTSIPNDTDWVHLNTLQCNVNSYSSYERSFDFTNKQHGWKPALGKPSLVERTNHGQFQAMATRPYYNPELPCRYLTTPPPGAPALQTVITTTTKVSYQAYQPPAMKYSDSVREVKSLSSCNYAPEDTGMSVYPEPWGPPVTVTRAASPSGPPPMKIAGDCRAIRPTVAIPHEPVSSRTDEAETWDVCLSGLGSAVSYSDRVGPFFTYNNEDF

SEQ ID NO: 34683 - protein, 432 aa, Homo sapiens
  Payload ID: 6849
  Gene Symbol: GFAP
  Gene Name: glial fibrillary acidic protein
  Uniprot ID: P14136
  ENSP ID: ENSP00000253408
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRETSLDTKSVSEGHLKRNIVVKTVEMRDGEVIKESKQEHKDVM

SEQ ID NO: 34684 - protein, 179 aa, Homo sapiens
  Payload ID: 6849
  Gene Symbol: GFAP
  Gene Name: glial fibrillary acidic protein
  ENSP ID: ENSP00000366189
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKKQMKPPWPVWIWRGRLSRWRRRSGS

SEQ ID NO: 34685 - protein, 431 aa, Homo sapiens
  Payload ID: 6849
  Gene Symbol: GFAP
  Gene Name: glial fibrillary acidic protein
  Uniprot ID: P14136
  ENSP ID: ENSP00000403962
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRGGKSTKDGENHKVTRYLKSLTIRVIPIQAHQIVNGTPPARG

SEQ ID NO: 34686 - protein, 12 aa, Homo sapiens
  Payload ID: 6849
  Gene Symbol: GFAP
  Gene Name: glial fibrillary acidic protein
  ENSP ID: ENSP00000464795
MWSLTWPSQTSP

SEQ ID NO: 34687 - protein, 61 aa, Homo sapiens
  Payload ID: 6849
  Gene Symbol: GFAP
  Gene Name: glial fibrillary acidic protein
  ENSP ID: ENSP00000465208
MERRRITSAARRSYVSSGEMMVGGLAPGRRLGPGTRLSLARMPPPLPTRVDFSLAGALNAG

SEQ ID NO: 34688 - protein, 248 aa, Homo sapiens
  Payload ID: 6849
  Gene Symbol: GFAP
  Gene Name: glial fibrillary acidic protein
  ENSP ID: ENSP00000465320
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEYQDLLNVKLALDIEIATYRKLLEGEENRITIPVQTFSNLQI

SEQ ID NO: 34689 - protein, 57 aa, Homo sapiens
  Payload ID: 6849
  Gene Symbol: GFAP
  Gene Name: glial fibrillary acidic protein
  ENSP ID: ENSP00000465565
MASSNMHEAEEWYRSKFADLTDAAARNAELLRQAKHEANDYRRQLQSLTCDLESLRG

SEQ ID NO: 34690 - protein, 191 aa, Homo sapiens
  Payload ID: 6849
  Gene Symbol: GFAP
  Gene Name: glial fibrillary acidic protein
  ENSP ID: ENSP00000465624
  MOD_RES (1)..(1): Any amino acid
XTEIATERGRDRDREAETERDTQREERNRDWQEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIAT

SEQ ID NO: 34691 - protein, 261 aa, Homo sapiens
  Payload ID: 6849
  Gene Symbol: GFAP
  Gene Name: glial fibrillary acidic protein
  ENSP ID: ENSP00000465629
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEVRELQEQLARQQVHVELDVAKPDLTAALKEIRTQYEAMASSNMHEAEEWYRSKFADLTDAAARNAELLRQAKHEANDYRRQLQSLT

SEQ ID NO: 34692 - protein, 189 aa, Homo sapiens
  Payload ID: 6849
  Gene Symbol: GFAP
  Gene Name: glial fibrillary acidic protein
  ENSP ID: ENSP00000466163
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKNVSPHSRLQDETNLRLEAENNLAAYRQEADEATLA

SEQ ID NO: 34693 - protein, 58 aa, Homo sapiens
  Payload ID: 6849
  Gene Symbol: GFAP
  Gene Name: glial fibrillary acidic protein
  ENSP ID: ENSP00000466598
MERRRITSAARRSYVSSGEMMVGGLAPGHLKRNIVVKTVEMRDGEVIKESKQEHKDVM

SEQ ID NO: 34694 - protein, 8 aa, Homo sapiens
  Payload ID: 6849
  Gene Symbol: GFAP
  Gene Name: glial fibrillary acidic protein
  ENSP ID: ENSP00000467106
MERRRITS

SEQ ID NO: 34695 - protein, 64 aa, Homo sapiens
  Payload ID: 6849
  Gene Symbol: GFAP
  Gene Name: glial fibrillary acidic protein
  ENSP ID: ENSP00000467397
FSNLQIRGGKSTKDGENHKVTRYLKSLTIRVIPIQAHQIVNGTPPARETSLDTKSVSEGHLKRN

SEQ ID NO: 34696 - protein, 101 aa, Homo sapiens
  Payload ID: 6849
  Gene Symbol: GFAP
  Gene Name: glial fibrillary acidic protein
  ENSP ID: ENSP00000467530
IPVQTFSNLQIRETSLDTKSVSEGHLKRNIVVKTVEMRDGEVRRDLGPVRLWLAPGILKARPWRKAWGWHIEGSQQLPVAPQGILEESKETECNSVSSVPP

SEQ ID NO: 34697 - protein, 438 aa, Homo sapiens
  Payload ID: 6849
  Gene Symbol: GFAP
  Gene Name: glial fibrillary acidic protein
  Uniprot ID: P14136
  ENSP ID: ENSP00000468500
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRGQYSRASWEGHWSPAPSSRACRLLQTGTEDQGKGIQLSLGAFVTLQRS

SEQ ID NO: 34698 - protein, 286 aa, Homo sapiens
  Payload ID: 6850
  Gene Symbol: GBAS
  Gene Name: glioblastoma amplified sequence
  Uniprot ID: O75323
  ENSP ID: ENSP00000313050
MAARVLRARGAAWAGGLLQRAAPCSLLPRLRTWTSSSNRSREDSWLKSLFVRKVDPRKDAHSNLLAKKETSNLYKLQFHNVKPECLEAYNKICQEVLPKIHEDKHYPCTLVGTWNTWYGEQDQAVHLWRYEGGYPALTEVMNKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 34699 - protein, 145 aa, Homo sapiens
  Payload ID: 6850
  Gene Symbol: GBAS
  Gene Name: glioblastoma amplified sequence
  ENSP ID: ENSP00000398498
MAARVLRARGAAWAGGLLQRAAPCSLLPRLRTWTSSSNRSREDSWLKSLFVRKVDPRKDAHSNLLAKKETSNLYKLQFHNVKPECLEAYNKICSSLFAEHKDLTPAWFLGVPIMGFCPTHPVLGTSTACLTISIQSRGVAKDSRR

SEQ ID NO: 34700 - protein, 80 aa, Homo sapiens
  Payload ID: 6850
  Gene Symbol: GBAS
  Gene Name: glioblastoma amplified sequence
  ENSP ID: ENSP00000401185
MNKLRENKEFLEFRKARSDMLLSRKNQLLLEFSFWNEPVPRSGPNIYELRSYQLRPGTMIEWGNYWARAIRFRQDGNEAV

SEQ ID NO: 34701 - protein, 65 aa, Homo sapiens
  Payload ID: 6850
  Gene Symbol: GBAS
  Gene Name: glioblastoma amplified sequence
  ENSP ID: ENSP00000406336
MNKLRENKEFLEFRKARSDMLLSRKNQLLLEFSFWNEPVPRSGPNIYELRSYQLRPGTMIEWGNY

SEQ ID NO: 34702 - protein, 247 aa, Homo sapiens
  Payload ID: 6850
  Gene Symbol: GBAS
  Gene Name: glioblastoma amplified sequence
  Uniprot ID: O75323
  ENSP ID: ENSP00000406855
MAARVLRARGAAWAGGLLQRAAPCSLLPRLRTWTSSSNRSREDSWLKSLFVRKVDPRKDAHSNLLAKKETSNLYKLQFKRCCQRFTKINTTLVLWWGLGTRGMASRTKLEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 34703 - protein, 114 aa, Homo sapiens
  Payload ID: 6850
  Gene Symbol: GBAS
  Gene Name: glioblastoma amplified sequence
  ENSP ID: ENSP00000409266
  MOD_RES (1)..(1): Any amino acid
XQEVLPKIHEDKHYPCTLVGTWNTWYGEQDQAVHLWRYEGGYPALTEVMNKLRENKEFLEFRKARSDMLLSRKNQLLLEFSFWNEPVPRSGPNIYELRSYQLRPGTMIEWGNYW

SEQ ID NO: 34704 - protein, 1560 aa, Homo sapiens [sequence omitted]

SEQ ID NO: 34705 - protein, 126 aa, Homo sapiens
  Payload ID: 6851
  Gene Symbol: GLTSCR1
  Gene Name: glioma tumor suppressor candidate region gene 1
  ENSP ID: ENSP00000469738
MDDEDGRCLLDVICDPQALNDFLHGSEKLDSDDLLDNPGEAQSAFYEGPGLHVQEASGNHLNPEPNQPAPSVDLDFLEDDILGSPATGGGGGGSGGADQPCDILQQSLQEANITEQTLEAEAELDL

SEQ ID NO: 34706 - protein, 1508 aa, Homo sapiens
  Payload ID: 6851
  Gene Symbol: GLTSCR1
  Gene Name: glioma tumor suppressor candidate region gene 1
  ENSP ID: ENSP00000480219
MCKASGNHLNPEPNQPAPSVDLDFLEDDILGSPATGGGGGGSGGADQPCDILQQSLQEANITEQTLEAEAELDLGPFQLPTLQPADGGAGPTGAGGAAAVAAGPQALFPGSTDLLGLQGPPTVLTHQALVPPQDVVNKALSVQPFLQPVGLGNVTLQPIPGLQGLPNGSPGGATAATLGLAPIQVVGQPVMALNTPTSQLLAKQVPVSGYLASAAGPSEPVTLASAGVSPQGAGLVIQKNLSAAVATTLNGNSVFGGAGAASAPTGTPSGQPLAVAPGLGSSPLVPAPNVILHRTPTPIQPKPAGVLPPKLYQLTPKPFAPAGATLTIQGEPGALPQQPKAPQNLTFMAAGKAGQNVVLSGFPAPALQANVFKQPPATTTGAAPPQPPGALSKPMSVHLLNQGSSIVIPAQHMLPGQNQFLLPGAPAVQLPQQLSALPANVGGQILAAAAPHTGGQLIANPILTNQNLAGPLSLGPVLAPHSGAHSAHILSAAPIQVGQPALFQMPVSLAAGSLPTQSQPAPAGPAATTVLQGVTLPPSAVAMLNTPDGLVQPATPAAATGEAAPVLTVQPAPQAPPAVSTPLPLGLQQPQAQQPPQAPTPQAAAPPQATTPQPSPGLASSPEKIVLGQPPSATPTAILTQDSLQMFLPQERSQQPLSAEGPHLSVPASVIVSAPPPAQDPAPATPVAKGAGLGPQAPDSQASPAPAPQIPAAAPLKGPGPSSSPSLPHQAPLGDSPHLPSPHPTRPPSRPPSRPQSVSRPPSEPPLHPCPPPQAPPTLPGIFVIQNQLGVPPPASNPAPTAPGPPQPPLRPQSQPPEGPLPPAPHLPPSSTSSAVASSSETSSRLPAPTPSDFQLQFPPSQGPHKSPTPPPTLHLVPEPAAPPPPPPRTFQMVTTPFPALPQPKALLERFHQVPSGIILQNKAGGAPAAPQTSTSLGPLTSPAASVLVSGQAPSGTPTAPSHAPAPAPMAATGLPPLLPAENKAFASNLPTLNVAKAASSGPGKPSGLQYESKLSGLKKPPTLQPSKEACFLEHLHKHQGSVLHPDYKTAFPSFEDALHRLLPYHVYQGALPSPSDYHKVDEEFETVSTQLLKRTQAMLNKYRLLLLEESRRVSPSAEMVMIDRMFIQEEKTTLALDKQLAKEKPDEYVSSSRSLGLPIAASSEGHRLPGHGPLSSSAPGASTQPPPHLPTKLVIRHGGAGGSPSVTWARASSSLSSSSSSSSAASSLDADEDGPMPSRNRPPIKTYEARSRIGLKLKIKQEAGLSKVVHNTALDPVHQPPPPPATLKVAEPPPRPPPPPPPTGQMNGTVDHPPPAAPERKPLGTAPHCPRLPLRKTYRENVGGPGAPEGTPAGRARGGSPAPLPAKVDEATSGLIRELAAVEDELYQRMLKGPPPEPAASAAQGTGDPDWEAPGLPPAKRRKSESPDVDQASFSSDSPQDDTLTEHLQSAIDSILNLQQAPGRTPAPSYPHAASAGTPASPPPLHRPEAYPPSSHNGGLGARTLTR

SEQ ID NO: 34707 - protein, 478 aa, Homo sapiens
  Payload ID: 6852
  Gene Symbol: GLTSCR2
  Gene Name: glioma tumor suppressor candidate region gene 2
  Uniprot ID: Q9NZM5
  ENSP ID: ENSP00000246802
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWEKLAKQGELPREVRRAQARLLNPSATRAKPGPQDTVERPFYDLWASDNPLDRPLVGQDEFFLEQTKKKGVKRPARLHTKPSQAPAVEVAPAGASYNPSFEDHQTLLSAAHEVELQRQKEAEKLERQLALPATEQAATQESTFQELCEGLLEESDGEGEPGQGEGPEAGDAEVCPTPARLATTEKKTEQQRRREKAVHRLRVQQAALRAARLRHQELFRLRGIKAQVALRLAELARRQRRRQARREAEADKPRRLGRLKYQAPDIDVQLSSELTDSLRTLKPEGNILRDRFKSFQRRNMIEPRERAKFKRKYKVKLVEKRAFREIQL

SEQ ID NO: 34708 - protein, 265 aa, Homo sapiens
  Payload ID: 6852
  Gene Symbol: GLTSCR2
  Gene Name: glioma tumor suppressor candidate region gene 2
  ENSP ID: ENSP00000468948
  MOD_RES (1)..(1): Any amino acid
XLTKKRTKVQKKSLLLKKPLRVDLILENTSKVPAPKDVLAHQVPNAKKLRRKEQLWEKLAKQGELPREVRRAQARLLNPSATRAKPGPQDTVERPFYDLWASDNPLDRPLVGQDEFFLEQTKKKGVKRPARLHTKPSQAPAVEVAPAGASYNPSFEDHQTLLSAAHEVELQRQKEAEKLERQLALPATEQAATQESTFQELCEGLLEESDAELGADRLAQDPEARGQHPSRPVQELPEEEYDRASRESQVQTQVQGEAGGEAGVP

SEQ ID NO: 34709 - protein, 149 aa, Homo sapiens
  Payload ID: 6852
  Gene Symbol: GLTSCR2
  Gene Name: glioma tumor suppressor candidate region gene 2
  ENSP ID: ENSP00000470190
  MOD_RES (1)..(1): Any amino acid
XATRAKPGPQDTVERPFYDLWASDNPLDRPLVGQDEFFLEQTKKKGVKRPARLHTKPSQAPAVEARREAEADKPRRLGRLKYQAPDIDVQLSSELTDSLRTLKPEGNILRDRFKSFQRRNMIEPRERAKFKRKYKVKLVEKRAFREIQL

SEQ ID NO: 34710 - protein, 200 aa, Homo sapiens
  Payload ID: 6852
  Gene Symbol: GLTSCR2
  Gene Name: glioma tumor suppressor candidate region gene 2
  ENSP ID: ENSP00000470263
LILENTSKVPAPKDVLAHQVPNAKKLRRKEQLWEKLAKQGELPREVRRAQARLLNPSATRAKPGPQDTVERPFYDLWASDNPLDRPLVGQDEFFLEQTKKKGVKRPARLHTKPSQARREAEADKPRRLGRLKYQAPDIDVQLSSELTDSLRTLKPEGNILRDRFKSFQRRNMIEPRERAKFKRKYKVKLVEKRAFREIQL

SEQ ID NO: 34711 - protein, 99 aa, Homo sapiens
  Payload ID: 6852
  Gene Symbol: GLTSCR2
  Gene Name: glioma tumor suppressor candidate region gene 2
  ENSP ID: ENSP00000470773
ARREAEADKPRRLGRLKYQAPDIDVQLSSELTDSLRTLKPEGNILRDRFKSFQRRNMIEPRERAKFKRKYKVKLVEKRAFREIHCHQMPETRPSIKNLF

SEQ ID NO: 34712 - protein, 551 aa, Homo sapiens
  Payload ID: 6853
  Gene Symbol: GLDN
  Gene Name: gliomedin
  Uniprot ID: Q6ZMI3
  ENSP ID: ENSP00000335196
MARGAEGGRGDAGWGLRGALAAVALLSALNAAGTVFALCQWRGLSSALRALEAQRGREQREDSALRSFLAELSRAPRGASAPPQDPASSARNKRSHSGEPAPHIRAESHDMLMMMTYSMVPIRVMVDLCNSTKGICLTGPSGPPGPPGAGGLPGHNGLDGQPGPQGPKGEKGANGKRGKMGIPGAAGNPGERGEKGDHGELGLQGNEGPPGQKGEKGDKGDVSNDVLLAGAKGDQGPPGPPGPPGPPGPPGPPGSRRAKGPRQPSMFNGQCPGETCAIPNDDTLVGKADEKASEHHSPQAESMITSIGNPVQVLKVTETFGTWIRESANKSDDRIWVTEHFSGIMVKEFKDQPSLLNGSYTFIHLPYYFHGCGHVVYNNSLYYHKGGSNTLVRFEFGQETSQTLKLENALYFDRKYLFANSKTYFNLAVDEKGLWIIYASSVDGSSILVAQLDERTFSVVQHVNTTYPKSKAGNAFIARGILYVTDTKDMRVTFAFDLLGGKQINANFDLRTSQSVLAMLAYNMRDQHLYSWEDGHLMLYPVQFLSTTLNQ

SEQ ID NO: 34713 - protein, 427 aa, Homo sapiens
  Payload ID: 6853
  Gene Symbol: GLDN
  Gene Name: gliomedin
  Uniprot ID: Q6ZMI3
  ENSP ID: ENSP00000379681
MVDLCNSTKGICLTGPSGPPGPPGAGGLPGHNGLDGQPGPQGPKGEKGANGKRGKMGIPGAAGNPGERGEKGDHGELGLQGNEGPPGQKGEKGDKGDVSNDVLLAGAKGDQGPPGPPGPPGPPGPPGPPGSRRAKGPRQPSMFNGQCPGETCAIPNDDTLVGKADEKASEHHSPQAESMITSIGNPVQVLKVTETFGTWIRESANKSDDRIWVTEHFSGIMVKEFKDQPSLLNGSYTFIHLPYYFHGCGHVVYNNSLYYHKGGSNTLVRFEFGQETSQTLKLENALYFDRKYLFANSKTYFNLAVDEKGLWIIYASSVDGSSILVAQLDERTFSVVQHVNTTYPKSKAGNAFIARGILYVTDTKDMRVTFAFDLLGGKQINANFDLRTSQSVLAMLAYNMRDQHLYSWEDGHLMLYPVQFLSTTLNQ

SEQ ID NO: 34714 - protein, 165 aa, Homo sapiens
  Payload ID: 6853
  Gene Symbol: GLDN
  Gene Name: gliomedin
  ENSP ID: ENSP00000453433
MTLSPLQIRVMVDLCNSTKGICLTGPSGPPGPPGAGGLPGHNGLDGQPGPQGPKGEKGANGKRGKMGIPGAAGNPGERGEKGDHGELGLQGNEGPPGQKGEKGDKGDVSNDVLLAGAKGDQGPPGPPGPPGPPGPPGPPGSRRAKGPRQPSMFNGQCPGETCAIP

SEQ ID NO: 34715 - protein, 427 aa, Homo sapiens; identical to SEQ ID NO: 34713
  Payload ID: 6853
  Gene Symbol: GLDN
  Gene Name: gliomedin
  Uniprot ID: Q6ZMI3
  ENSP ID: ENSP00000479249

SEQ ID NO: 34716 - protein, 151 aa, Homo sapiens
  Payload ID: 6853
  Gene Symbol: GLDN
  Gene Name: gliomedin
  ENSP ID: ENSP00000484633
  MOD_RES (1)..(1): Any amino acid
XCQWRGLSSALRALEAQRGREQREDSALRSFLAELSRAPRGASAPPQDPASSARNKRSHSGEPAPHIRAESHDMLMMMTYSMVPIRVMVDLCNSTKGICLTGPSGPPGPPGAGGLPGHNGLDGQPGPQGPKGEKGANGKRGKMGIFGNSSN

SEQ ID NO: 34717 - protein, 620 aa, Homo sapiens
  Payload ID: 6854
  Gene Symbol: GLIS1
  Gene Name: GLIS family zinc finger 1
  Uniprot ID: Q8NBF1
  ENSP ID: ENSP00000309653
MAEARTSLSAHCRGPLATGLHPDLDLPGRSLATPAPSCYLLGSEPSSGLGLQPETHLPEGSLKRCCVLGLPPTSPASSSPCASSDVTSIIRSSQTSLVTCVNGLRSPPLTGDLGGPSKRARPGPASTDSHEGSLQLEACRKASFLKQEPADEFSELFGPHQQGLPPPYPLSQLPPGPSLGGLGLGLAGRVVAGRQACRWVDCCAAYEQQEELVRHIEKSHIDQRKGEDFTCFWAGCVRRYKPFNARYKLLIHMRVHSGEKPNKCMFEGCSKAFSRLENLKIHLRSHTGEKPYLCQHPGCQKAFSNSSDRAKHQRTHLDTKPYACQIPGCSKRYTDPSSLRKHVKAHSAKEQQVRKKLHAGPDTEADVLTECLVLQQLHTSTQLAASDGKGGCGLGQELLPGVYPGSITPHNGLASGLLPPAHDVPSRHHPLDATTSSHHHLSPLPMAESTRDGLGPGLLSPIVSPLKGLGPPPLPPSSQSHSPGGQPFPTLPSKPSYPPFQSPPPPPLPSPQGYQGSFHSIQSCFPYGDCYRMAEPAAGGDGLVGETHGFNPLRPNGYHSLSTPLPATGYEALAEASCPTALPQQPSEDVVSSGPEDCGFFPNGAFDHCLGHIPSIYTDT

SEQ ID NO: 34718 - protein, 795 aa, Homo sapiens
  Payload ID: 6854
  Gene Symbol: GLIS1
  Gene Name: GLIS family zinc finger 1
  ENSP ID: ENSP00000486112
MHCEVAEAHSDKRPKEAPGAPGPDRGPASLGAHMAFRVTVSGGGCGDRGPRDLLARPPAPPPRAHDLLRPRSPRDYGPSKAAAAGKVNGSYGHRTPGSEKSLLDLDLAEGPGPTCCQGLFLPAGSPPPRAHPQACERLLHFPHPDRSPRPQATYVNGSLPTTQHIKQESLPDYQAMAEARTSLSAHCRGPLATGLHPDLDLPGRSLATPAPSCYLLGSEPSSGLGLQPETHLPEGSLKRCCVLGLPPTSPASSSPCASSDVTSIIRSSQTSLVTCVNGLRSPPLTGDLGGPSKRARPGPASTDSHEGSLQLEACRKASFLKQEPADEFSELFGPHQQGLPPPYPLSQLPPGPSLGGLGLGLAGRVVAGRQACRWVDCCAAYEQQEELVRHIEKSHIDQRKGEDFTCFWAGCVRRYKPFNARYKLLIHMRVHSGEKPNKCMFEGCSKAFSRLENLKIHLRSHTGEKPYLCQHPGCQKAFSNSSDRAKHQRTHLDTKPYACQIPGCSKRYTDPSSLRKHVKAHSAKEQQVRKKLHAGPDTEADVLTECLVLQQLHTSTQLAASDGKGGCGLGQELLPGVYPGSITPHNGLASGLLPPAHDVPSRHHPLDATTSSHHHLSPLPMAESTRDGLGPGLLSPIVSPLKGLGPPPLPPSSQSHSPGGQPFPTLPSKPSYPPFQSPPPPPLPSPQGYQGSFHSIQSCFPYGDCYRMAEPAAGGDGLVGETHGFNPLRPNGYHSLSTPLPATGYEALAEASCPTALPQQPSEDVVSSGPEDCGFFPNGAFDHCLGHIPSIYTDT

SEQ ID NO: 34719 - protein, 524 aa, Homo sapiens
  Payload ID: 6855
  Gene Symbol: GLIS2
  Gene Name: GLIS family zinc finger 2
  Uniprot ID: Q9BZE0
  ENSP ID: ENSP00000262366
MHSLDEPLDLKLSITKLRAAREKRERTLGVVRPRALHRELGLVDDSPTPGSPGSPPSGFLLNSKFPEKVEGRFSAAPLVDLSLSPPSGLDSPNGSSSLSPERQGNGDLPPVPSASDFQPLRYLDGVPSSFQFFLPLGSGGALHLPASSFLTPPKDKCLSPDLPLPKQLVCRWAKCNQLFELLQDLVDHVNDYHVKPEKDAGYCCHWEGCARHGRGFNARYKMLIHIRTHTNEKPHRCPTCSKSFSRLENLKIHNRSHTGEKPYVCPYEGCNKRYSNSSDRFKHTRTHYVDKPYYCKMPGCHKRYTDPSSLRKHIKAHGHFVSHEQQELLQLRPPPKPPLPAPDGGPYVSGAQIIIPNPAALFGGPGLPGLPLPLAPGPLDLSALACGNGGGSGGGGGMGPGLPGPVLPLNLAKNPLLPSPFGAGGLGLPVVSLLAGAAGGKAEGEKGRGSVPTRALGMEGHKTPLERTESSCSRPSPDGLPLLPGTVLDLSTGVNSAASSPEALAPGWVVIPPGSVLLKPAVVN

SEQ ID NO: 34720 - protein, 524 aa, Homo sapiens; identical to SEQ ID NO: 34719
  Payload ID: 6855
  Gene Symbol: GLIS2
  Gene Name: GLIS family zinc finger 2
  Uniprot ID: Q9BZE0
  ENSP ID: ENSP00000395547

SEQ ID NO: 34721 - protein, 524 aa, Homo sapiens; identical to SEQ ID NO: 34719
  Payload ID: 6855
  Gene Symbol: GLIS2
  Gene Name: GLIS family zinc finger 2
  Uniprot ID: Q9BZE0
  ENSP ID: ENSP00000484027

SEQ ID NO: 34722 - protein, 524 aa, Homo sapiens; identical to SEQ ID NO: 34719
  Payload ID: 6855
  Gene Symbol: GLIS2
  Gene Name: GLIS family zinc finger 2
  Uniprot ID: Q9BZE0
  ENSP ID: ENSP00000488242

SEQ ID NO: 34723 - protein, 775 aa, Homo sapiens
  Payload ID: 6856
  Gene Symbol: GLIS3
  Gene Name: GLIS family zinc finger 3
  Uniprot ID: Q8NEA6
  ENSP ID: ENSP00000325494
MMVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVAYINGSRASPANLSPQPEVYGHFLGVRGSCIPQPRPVPGSQKGVLVAPGGLALPAYGEDGALEHERMQQLEHGGLQPGLVNHMVVQHGLPGPDSQSAGLFKTERLEEFPGSTVDLPPAPPLPPLPPPPGPPPPYHAHAHLHHPELGPHAQQLALPQATLDDDGEMDGIGGKHCCRWIDCSALYDQQEELVRHIEKVHIDQRKGEDFTCFWAGCPRRYKPFNARYKLLIHMRVHSGEKPNKCTFEGCEKAFSRLENLKIHLRSHTGEKPYLCQHPGCQKAFSNSSDRAKHQRTHLDTKPYACQIPGCTKRYTDPSSLRKHVKAHSSKEQQARKKLRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGFYGQLQKFCPPHYPDSQRIVPPVSSCSVVPSFEDCLVPTSMGQASFDVFHRAFSTHSGITVYDLPSSSSSLFGESLRSGAEDATFLQISTVDRCPSQLSSVYTEG

SEQ ID NO: 34724 - protein, 930 aa, Homo sapiens
  Payload ID: 6856
  Gene Symbol: GLIS3
  Gene Name: GLIS family zinc finger 3
  Uniprot ID: Q8NEA6
  ENSP ID: ENSP00000371398
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGALGFGPQCKSIGKGSCNNLVVTSSPMMVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVAYINGSRASPANLSPQPEVYGHFLGVRGSCIPQPRPVPGSQKGVLVAPGGLALPAYGEDGALEHERMQQLEHGGLQPGLVNHMVVQHGLPGPDSQSAGLFKTERLEEFPGSTVDLPPAPPLPPLPPPPGPPPPYHAHAHLHHPELGPHAQQLALPQATLDDDGEMDGIGGKHCCRWIDCSALYDQQEELVRHIEKVHIDQRKGEDFTCFWAGCPRRYKPFNARYKLLIHMRVHSGEKPNKCTFEGCEKAFSRLENLKIHLRSHTGEKPYLCQHPGCQKAFSNSSDRAKHQRTHLDTKPYACQIPGCTKRYTDPSSLRKHVKAHSSKEQQARKKLRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGFYGQLQKFCPPHYPDSQRIVPPVSSCSVVPSFEDCLVPTSMGQASFDVFHRAFSTHSGITVYDLPSSSSSLFGESLRSGAEDATFLQISTVDRCPSQLSSVYTEG

SEQ ID NO: 34725 - protein, 244 aa, Homo sapiens
  Payload ID: 6856
  Gene Symbol: GLIS3
  Gene Name: GLIS family zinc finger 3
  ENSP ID: ENSP00000417794
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGALGFGPQCKSIGKGSCNNLVVTSSPMMVQRLGLISPPASQVSTACNQISPSLQRAMNAANLNIPPSDTRSLISRESLASTTLSLTESQSASSMKQEWSQGYRALPSLSNHGSQN

SEQ ID NO: 34726 - protein, 244 aa, Homo sapiens; identical to SEQ ID NO: 34725
  Payload ID: 6856
  Gene Symbol: GLIS3
  Gene Name: GLIS family zinc finger 3
  ENSP ID: ENSP00000417883

SEQ ID NO: 34727 - protein, 89 aa, Homo sapiens
  Payload ID: 6856
  Gene Symbol: GLIS3
  Gene Name: GLIS family zinc finger 3
  ENSP ID: ENSP00000418005
MMVQRLGLISPPASQVSTACNQISPSLQRAMNAANLNIPPSDTRSLISRESLASTTLSLTESQSASSMKQEWSQGYRALPSLSNHGSQN

SEQ ID NO: 34728 - protein, 89 aa, Homo sapiens; identical to SEQ ID NO: 34727
  Payload ID: 6856
  Gene Symbol: GLIS3
  Gene Name: GLIS family zinc finger 3
  ENSP ID: ENSP00000418671

SEQ ID NO: 34729 - protein, 89 aa, Homo sapiens; identical to SEQ ID NO: 34727
  Payload ID: 6856
  Gene Symbol: GLIS3
  Gene Name: GLIS family zinc finger 3
  ENSP ID: ENSP00000418995

SEQ ID NO: 34730 - protein, 142 aa, Homo sapiens
  Payload ID: 6856
  Gene Symbol: GLIS3
  Gene Name: GLIS family zinc finger 3
  ENSP ID: ENSP00000419914
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGPLFRVSLWRPRP

SEQ ID NO: 34731 - protein, 72 aa, Homo sapiens
  Payload ID: 6857
  Gene Symbol: GBGT1
  Gene Name: globoside alpha-1,3-N-acetylgalactosaminyltransferase 1
  ENSP ID: ENSP00000361106
MHRRRLALGLGFCLLAGTSLSVLWVYLENWLPVSYVPYYLPCPEILLEYRGVISAHCNLHLPGSSNCHASAT

SEQ ID NO: 34732 - protein, 160 aa, Homo sapiens
  Payload ID: 6857
  Gene Symbol: GBGT1
  Gene Name: globoside alpha-1,3-N-acetylgalactosaminyltransferase 1
  ENSP ID: ENSP00000361108
MHRRRLALGLGFCLLAGTSLSVLWVYLENWLPVSYVPYYLPCPEILPMMMALSCLCHQQHEAALQEGEATPARGMVTVPSAQAAGAQAHTAADTHTLVGAHRLRGNLQPRASAAHLPATEPDHWGHGVCRGEVHSFHPVLPGVSRGVLHAWVPGALLHLH

SEQ ID NO: 34733 - protein, 347 aa, Homo sapiens
  Payload ID: 6857
  Gene Symbol: GBGT1
  Gene Name: globoside alpha-1,3-N-acetylgalactosaminyltransferase 1
  Uniprot ID: Q8N5D6
  ENSP ID: ENSP00000361110
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 34734 - protein, 294 aa, Homo sapiens
  Payload ID: 6857
  Gene Symbol: GBGT1
  Gene Name: globoside alpha-1,3-N-acetylgalactosaminyltransferase 1
  Uniprot ID: Q8N5D6
  ENSP ID: ENSP00000361113
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGNPSWSQPRSSSCVGTGCTTTSSLTTLQPFPGSRWVPTGFSAPSPSRVTPTGRRHPCAGWRPSASTLLRGLTGRWTTSSALMWTWCFGTRGALRPWETWWLPFTQATTPFPASSSPMSAGVFPLPLWQTAKGTSIMVGQSSGGRWPGYMSLLGAATWPSWRTRPMASWLPGGRKAT

SEQ ID NO: 34735 - protein, 330 aa, Homo sapiens
  Payload ID: 6857
  Gene Symbol: GBGT1
  Gene Name: globoside alpha-1,3-N-acetylgalactosaminyltransferase 1
  Uniprot ID: Q8N5D6
  ENSP ID: ENSP00000437663
MHRRRLALGLGFCLLAGTSLSVLWVYLENWLPVSYVPYYLPCPEILSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 34736 - protein, 594 aa, Homo sapiens
  Payload ID: 6858
  Gene Symbol: GLMN
  Gene Name: glomulin, FKBP associated protein
  Uniprot ID: Q92990
  ENSP ID: ENSP00000359385
MAVEELQSIIKRCQILEEQDFKEEDFGLFQLAGQRCIEEGHTDQLLEIIQNEKNKVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFRCLLNTSNHSGVEAFIIQNIKNQIDMSLKRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 34737 - protein, 417 aa, Homo sapiens
  Payload ID: 6858
  Gene Symbol: GLMN
  Gene Name: glomulin, FKBP associated protein
  Uniprot ID: Q92990
  ENSP ID: ENSP00000436829
MAVEELQSIIKRCQILEEQDFKEEDFGLFQLAGQRCIEEGHTDQLLEIIQNEKNKVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFREHVTTNGLQDHS

SEQ ID NO: 34738 - protein, 245 aa, Homo sapiens
  Payload ID: 6858
  Gene Symbol: GLMN
  Gene Name: glomulin, FKBP associated protein
  ENSP ID: ENSP00000468973
  MOD_RES (1)..(1): Any amino acid
XCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLEVQVWMYYMHKMDSDEVWRTRNNKWFTGPQLISLLDLVLFLPEGAETDLLQNSDRIMASLNLLRYLVIKDNENDN

SEQ ID NO: 34739 - protein, 297 aa, Homo sapiens
  Payload ID: 6858
  Gene Symbol: GLMN
  Gene Name: glomulin, FKBP associated protein
  ENSP ID: ENSP00000469157
GFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQRKKSLAMLQLYINKLDSQGKYTLFRCLLNTSNHSGVEAFIIQNIKNQIDMSLKRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLK

SEQ ID NO: 34740 - protein, 1079 aa, Homo sapiens
  Payload ID: 6859
  Gene Symbol: GLTSCR1L
  Gene Name: GLTSCR1-like
  Uniprot ID: Q6AI39
  ENSP ID: ENSP00000313933
MDDDDDSCLLDLIGDPQALNYFLHGPSNKSSNDDLTNAGYSAANSNSIFANSSNADPKSSLKGVSNQLGEGPSDGLPLSSSLQFLEDELESSPLPDLTEDQPFDILQKSLQEANITEQTLAEEAYLDASIGSSQQFAQAQLHPSSSASFTQASNVSNYSGQTLQPIGVTHVPVGASFASNTVGVQHGFMQHVGISVPSQHLSNSSQISGSGQIQLIGSFGNHPSMMTINNLDGSQIILKGSGQQAPSNVSGGLLVHRQTPNGNSLFGNSSSSPVAQPVTVPFNSTNFQTSLPVHNIIIQRGLAPNSNKVPINIQPKPIQMGQQNTYNVNNLGIQQHHVQQGISFASASSPQGSVVGPHMSVNIVNQQNTRKPVTSQAVSSTGGSIVIHSPMGQPHAPQSQFLIPTSLSVSSNSVHHVQTINGQLLQTQPSQLISGQVASEHVMLNRNSSNMLRTNQPYTGPMLNNQNTAVHLVSGQTFAASGSPVIANHASPQLVGGQMPLQQASPTVLHLSPGQSSVSQGRPGFATMPSVTSMSGPSRFPAVSSASTAHPSLGSAVQSGSSGSNFTGDQLTQPNRTPVPVSVSHRLPVSSSKSTSTFSNTPGTGTQQQFFCQAQKKCLNQTSPISAPKTTDGLRQAQIPGLLSTTLPGQDSGSKVISASLGTAQPQQEKVVGSSPGHPAVQVESHSGGQKRPAAKQLTKGAFILQQLQRDQAHTVTPDKSHFRSLSDAVQRLLSYHVCQGSMPTEEDLRKVDNEFETVATQLLKRTQAMLNKYRCLLLEDAMRINPSAEMVMIDRMFNQEERASLSRDKRLALVDPEGFQADFCCSFKLDKAAHETQFGRSDQHGSKASSSLQPPAKAQGRDRAKTGVTEPMNHDQFHLVPNHIVVSAEGNISKKTECLGRALKFDKVGLVQYQSTSEEKASRREPLKASQCSPGPEGHRKTSSRSDHGTESKLSSILADSHLEMTCNNSFQDKSLRNSPKNEVLHTDIMKGSGEPQPDLQLTKSLETTFKNILELKKAGRQPQSDPTVSGSVELDFPNFSPMASQENCLEKFIPDHSEGVVETDSILEAAVNSILEC

SEQ ID NO: 34741 - protein, 1079 aa, Homo sapiens; identical to SEQ ID NO: 34740
  Payload ID: 6859
  Gene Symbol: GLTSCR1L
  Gene Name: GLTSCR1-like
  Uniprot ID: Q6AI39
  ENSP ID: ENSP00000377723

SEQ ID NO: 34742 - protein, 1079 aa, Homo sapiens; identical to SEQ ID NO: 34740
  Payload ID: 6859
  Gene Symbol: GLTSCR1L
  Gene Name: GLTSCR1-like
  Uniprot ID: Q6AI39
  ENSP ID: ENSP00000482211

SEQ ID NO: 34743 - protein, 180 aa, Homo sapiens
  Payload ID: 6860
  Gene Symbol: GCG
  Gene Name: glucagon
  Uniprot ID: P01275
  ENSP ID: ENSP00000364647
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 34744 - protein, 180 aa, Homo sapiens; identical to SEQ ID NO: 34743
  Payload ID: 6860
  Gene Symbol: GCG
  Gene Name: glucagon
  Uniprot ID: P01275
  ENSP ID: ENSP00000387662

SEQ ID NO: 34745 - protein, 477 aa, Homo sapiens
  Payload ID: 6861
  Gene Symbol: GCGR
  Gene Name: glucagon receptor
  Uniprot ID: P47871
  ENSP ID: ENSP00000383558
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 34746 - protein, 80 aa, Homo sapiens
  Payload ID: 6861
  Gene Symbol: GCGR
  Gene Name: glucagon receptor
  ENSP ID: ENSP00000458930
MPPCQPQRPLLLLLLLLACQPQVPSAQVMDFLFEKWKLYGDQCHHNLSLLPPPTELVCNRTFDKYSCWPDTPANTTANIS

SEQ ID NO: 34747 - protein, 523 aa, Homo sapiens
  Payload ID: 6861
  Gene Symbol: GCGR
  Gene Name: glucagon receptor
  ENSP ID: ENSP00000460976
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGVSPPRRPQAGGWVGSQAGGHVAALTLHLYQAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQVPARPPAPPPGAQCATPDHPVSPGPAGGCPLLLPQQGGAVGAAAALAPLAPGQSAMGGAEHQQPQGLIFARPRPSQQGAAVWEGWWQPGFICGDPLGWWPP

SEQ ID NO: 34748 - protein, 463 aa, Homo sapiens
  Payload ID: 6862
  Gene Symbol: GLP1R
  Gene Name: glucagon-like peptide 1 receptor
  Uniprot ID: P43220
  ENSP ID: ENSP00000362353
MAGAPGPLRLALLLLGMVGRAGPRPQGATVSLWETVQKWREYRRQCQRSLTEDPPPATDLFCNRTFDEYACWPDGEPGSFVNVSCPWYLPWASSVPQGHVYRFCTAEGLWLQKDNSSLPWRDLSECEESKRGERSSPEEQLLFLYIIYTVGYALSFSALVIASAILLGFRHLHCTRNYIHLNLFASFILRALSVFIKDAALKWMYSTAAQQHQWDGLLSYQDSLSCRLVFLLMQYCVAANYYWLLVEGVYLYTLLAFSVLSEQWIFRLYVSIGWGVPLLFVVPWGIVKYLYEDEGCWTRNSNMNYWLIIRLPILFAIGVNFLIFVRVICIVVSKLKANLMCKTDIKCRLAKSTLTLIPLLGTHEVIFAFVMDEHARGTLRFIKLFTELSFTSFQGLMVAILYCFVNNEVQLEFRKSWERWRLEHLHIQRDSSMKPLKCPTSSLSSGATAGSSMYTATCQASCS

SEQ ID NO: 34749 - protein, 553 aa, Homo sapiens
  Payload ID: 6863
  Gene Symbol: GLP2R
  Gene Name: glucagon-like peptide 2 receptor
  Uniprot ID: O95838
  ENSP ID: ENSP00000262441
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 34750 - protein, 118 aa, Homo sapiens
  Payload ID: 6863
  Gene Symbol: GLP2R
  Gene Name: glucagon-like peptide 2 receptor
  ENSP ID: ENSP00000303605
MYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERR

SEQ ID NO: 34751 - protein, 93 aa, Homo sapiens
  Payload ID: 6863
  Gene Symbol: GLP2R
  Gene Name: glucagon-like peptide 2 receptor
  ENSP ID: ENSP00000404471
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSG

SEQ ID NO: 34752 - protein, 373 aa, Homo sapiens
  Payload ID: 6863
  Gene Symbol: GLP2R
  Gene Name: glucagon-like peptide 2 receptor
  ENSP ID: ENSP00000458242
MYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 34753 - protein, 702 aa, Homo sapiens
  Payload ID: 6864
  Gene Symbol: GBE1
  Gene Name: glucan (1,4-alpha-), branching enzyme 1
  Uniprot ID: Q04446
  ENSP ID: ENSP00000410833
MAAPMTPAARPEDYEAALNAALADVPELARLLEIDPYLKPYAVDFQRRYKQFSQILKNIGENEGGIDKFSRGYESFGVHRCADGGLYCKEWAPGAEGVFLTGDFNGWNPFSYPYKKLDYGKWELYIPPKQNKSVLVPHGSKLKVVITSKSGEILYRISPWAKYVVREGDNVNYDWIHWDPEHSYEFKHSRPKKPRSLRIYESHVGISSHEGKVASYKHFTCNVLPRIKGLGYNCIQLMAIMEHAYYASFGYQITSFFAASSRYGTPEELQELVDTAHSMGIIVLLDVVHSHASKNSADGLNMFDGTDSCYFHSGPRGTHDLWDSRLFAYSSWEILRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQAYVSEKHEGNKIIAFERAGLLFIFNFHPSKSYTDYRVGTALPGKFKIVLDSDAAEYGGHQRLDHSTDFFSEAFEHNGRPYSLLVYIPSRVALILQNVDLPN

SEQ ID NO: 34754 - protein, 661 aa, Homo sapiens
  Payload ID: 6864
  Gene Symbol: GBE1
  Gene Name: glucan (1,4-alpha-), branching enzyme 1
  ENSP ID: ENSP00000419638
MNLAKVRYKQFSQILKNIGENEGGIDKFSRGYESFGVHRCADGGLYCKEWAPGAEGVFLTGDFNGWNPFSYPYKKLDYGKWELYIPPKQNKSVLVPHGSKLKVVITSKSGEILYRISPWAKYVVREGDNVNYDWIHWDPEHSYEFKHSRPKKPRSLRIYESHVGISSHEGKVASYKHFTCNVLPRIKGLGYNCIQLMAIMEHAYYASFGYQITSFFAASSRYGTPEELQELVDTAHSMGIIVLLDVVHSHASKNSADGLNMFDGTDSCYFHSGPRGTHDLWDSRLFAYSSWEILRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQAYVSEKHEGNKIIAFERAGLLFIFNFHPSKSYTDYRVGTALPGKFKIVLDSDAAEYGGHQRLDHSTDFFSEAFEHNGRPYSLLVYIPSRVALILQNVDLPN

SEQ ID NO: 34755 - protein, 547 aa, Homo sapiens
  Payload ID: 6865
  Gene Symbol: GLCCI1
  Gene Name: glucocorticoid induced 1
  Uniprot ID: Q86VQ1
  ENSP ID: ENSP00000223145
MSTASSSSSSSSSQTPHPPSQRMRRSAAGSPPAVAAAGSGNGAGGGGGVGCAPAAGAGRLLQPIRATVPYQLLRGSQHSPTRPPVAAAAASLGSLPGPGAARGPSPSSPTPPAAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKDRQSPLHGNHITISHTQATGSRSVPMPLSNISVPKSSVSRVPCNVEGISPELEKVFIKENNGKEEVSKPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 34756 - protein, 191 aa, Homo sapiens
  Payload ID: 6865
  Gene Symbol: GLCCI1
  Gene Name: glucocorticoid induced 1
  ENSP ID: ENSP00000393942
  MOD_RES (1)..(1): Any amino acid
XSPLHGNHITISHTQATGSRSVPMPLSNISVPKSSVSRVPCNVEGISPELEKVFIKENNGKEEVSKPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMAQTPGVVSLSCFPSQ

SEQ ID NO: 34757 - protein, 193 aa, Homo sapiens
  Payload ID: 6865
  Gene Symbol: GLCCI1
  Gene Name: glucocorticoid induced 1
  ENSP ID: ENSP00000396171
AAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKDRQSPLHGNHITISHTQATGSSRWTYQMVEELHFLLITGAVVLAALTLRLL

SEQ ID NO: 34758 - protein, 191 aa, Homo sapiens
  Payload ID: 6865
  Gene Symbol: GLCCI1
  Gene Name: glucocorticoid induced 1
  ENSP ID: ENSP00000406569
AAAAPAEQAPRAKGRPRRSPESHRRSSSPERRSPGSPVCRADKAKSQQVRTSSTIRRTSSLDTITGPYLTGQWPRDPHVHYPSCMKDKATQIAKLRQQLQRSKQSSRHSKEKDRQSPLHGNHITISHTQATGSRSVPMPLSNISVPKSSVSRVPCNVEGISPELEKVFIKENNGKEEVSKPLDIPDGRRAP

SEQ ID NO: 34759 - protein, 573 aa, Homo sapiens
  Payload ID: 6866
  Gene Symbol: GMEB1
  Gene Name: glucocorticoid modulatory element binding protein 1
  Uniprot ID: Q9Y692
  ENSP ID: ENSP00000294409
MANAEVSVPVGDVVVVPTEGNEGENPEDTKTQVILQLQPVQQGLFIDGHFYNRIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPSPPVQQPQFTVISPITITPVGQSFSMGNIPVATLSQGSSPVTVHTLPSGPQLFRYATVVSSAKSSSPDTVTIHPSSSLALLSSTAMQDGSTLGNMTTMVSPVELVAMESGLTSAIQAVESTSEDGQTIIEIDPAPDPEAEDTEGKAVILETELRTEEKVVAEMEEHQHQVHNVEIVVLED

SEQ ID NO: 34760 - protein, 563 aa, Homo sapiens
  Payload ID: 6866
  Gene Symbol: GMEB1
  Gene Name: glucocorticoid modulatory element binding protein 1
  Uniprot ID: Q9Y692
  ENSP ID: ENSP00000355186
MANAEVSVPVGDVVVVPTEGNEGENPEDTKTQVILQLQPVQQGIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPSPPVQQPQFTVISPITITPVGQSFSMGNIPVATLSQGSSPVTVHTLPSGPQLFRYATVVSSAKSSSPDTVTIHPSSSLALLSSTAMQDGSTLGNMTTMVSPVELVAMESGLTSAIQAVESTSEDGQTIIEIDPAPDPEAEDTEGKAVILETELRTEEKVVAEMEEHQHQVHNVEIVVLED

SEQ ID NO: 34761 - protein, 563 aa, Homo sapiens; identical to SEQ ID NO: 34760
  Payload ID: 6866
  Gene Symbol: GMEB1
  Gene Name: glucocorticoid modulatory element binding protein 1
  Uniprot ID: Q9Y692
  ENSP ID: ENSP00000362922

SEQ ID NO: 34762 - protein, 530 aa, Homo sapiens
  Payload ID: 6867
  Gene Symbol: GMEB2
  Gene Name: glucocorticoid modulatory element binding protein 2
  Uniprot ID: Q9UKD1
  ENSP ID: ENSP00000266068
MATPDVSVHMEEVVVVTTPDTAVDGSGVEGVKTVLVTTNLAPHGGDLTEDNMETENAAAAAAAAFTASSQLKEAVLVKMAEEGENLEAEIVYPITCGDSRANLIWRKFVCPGINVKCVQYDEHVISPKEFVHLAGKSTLKDWKRAIRMNGIMLRKIMDSGELDFYQHDKVCSNTCRSTKIDLSGARVSLSSPTSAEYIPLTPAAADVNGSPATITIETCEDPGDWTAAIGDDTFTFWRGLKDAGLLDEVIQEFHQELVETMRGLQQRVQDPPLQLRDAVLLNNIVQNFGMLDLVKKVLASHKCQMDRSREQYARDLAALEQQCDEHRRRAKELKHKSQHLSNVLMTLTPVSLPPPVKRPRLARATSGPAAMASQVLTQSAQLALGPGVPVPQLTSVPLGKVVSTLPSTVLGKGSLQAPPASSPASPLLGGYTVLASSGSTYPSTVEIHPDASSLTVLSTAAVQDGSTVFKVVSPLQLLTLPGLGPTLQNVAQASPGSSTIVTVPAGAAPGPEEHTATIEVAAMAEDHERK

SEQ ID NO: 34763 - protein, 479 aa, Homo sapiens
  Payload ID: 6867
  Gene Symbol: GMEB2
  Gene Name: glucocorticoid modulatory element binding protein 2
  ENSP ID: ENSP00000359086
METENAAAAAAAAFTASSQLKEAVLVKMAEEGENLEAEIVYPITCGDSRANLIWRKFVCPGINVKCVQYDEHVISPKEFVHLAGKSTLKDWKRAIRMNGIMLRKIMDSGELDFYQHDKVCSNTCRSTKIDLSGARVSLSSPTSAEYIPLTPAAADVNGSPATITIETCEDPGDWTAAIGDDTFTFWRGLKDAGLLDEVIQEFHQELVETMRGLQQRVQDPPLQLRDAVLLNNIVQNFGMLDLVKKVLASHKCQMDRSREQYARDLAALEQQCDEHRRRAKELKHKSQHLSNVLMTLTPVSLPPPVKRPRLARATSGPAAMASQVLTQSAQLALGPGVPVPQLTSVPLGKVVSTLPSTVLGKGSLQAPPASSPASPLLGGYTVLASSGSTYPSTVEIHPDASSLTVLSTAAVQDGSTVFKVVSPLQLLTLPGLGPTLQNVAQASPGSSTIVTVPAGAAPGPEEHTATIEVAAMAEDHERK

SEQ ID NO: 34764 - protein, 530 aa, Homo sapiens; identical to SEQ ID NO: 34762
  Payload ID: 6867
  Gene Symbol: GMEB2
  Gene Name: glucocorticoid modulatory element binding protein 2
  Uniprot ID: Q9UKD1
  ENSP ID: ENSP00000359094

SEQ ID NO: 34765 - protein, 466 aa, Homo sapiens
  Payload ID: 6868
  Gene Symbol: GCK
  Gene Name: glucokinase (hexokinase 4)
  Uniprot ID: P35557
  ENSP ID: ENSP00000223366
MAMDVTRSQAQTALTLVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 34766 - protein, 149 aa, Homo sapiens
  Payload ID: 6868
  Gene Symbol: GCK
  Gene Name: glucokinase (hexokinase 4)
  ENSP ID: ENSP00000338009
GGVRTGMPRAGMGASLRPGTGPHPDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 34767 - protein, 464 aa, Homo sapiens
  Payload ID: 6868
  Gene Symbol: GCK
  Gene Name: glucokinase (hexokinase 4)
  Uniprot ID: P35557
  ENSP ID: ENSP00000379142
MPRPRSQLPQPNSQVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 34768 - protein, 465 aa, Homo sapiens [sequence omitted]

SEQ ID NO: 34769 - protein, 448 aa, Homo sapiens
  Payload ID: 6868
  Gene Symbol: GCK
  Gene Name: glucokinase (hexokinase 4)
  ENSP ID: ENSP00000402840
MLDDRARMEAAKKEKVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 34770 - protein, 464 aa, Homo sapiens; identical to SEQ ID NO: 34767
  Payload ID: 6868
  Gene Symbol: GCK
  Gene Name: glucokinase (hexokinase 4)
  Uniprot ID: P35557
  ENSP ID: ENSP00000482149

SEQ ID NO: 34771 - protein, 625 aa, Homo sapiens
  Payload ID: 6869
  Gene Symbol: GCKR
  Gene Name: glucokinase (hexokinase 4) regulator
  ENSP ID: ENSP00000264717
MPGTKRFQHVIETPEPGKWELSGYEAAVPITEKSNPLTQDLDKADAENIVRLLGQCDAEIFQEEGQALSTYQRLYSESILTTMVQVAGKVQEVLKEPDGGLVVLSGGGTSGRMAFLMSVSFNQLMKGLGQKPLYTYLIAGGDRSVVASREGTEDSALHGIEELKKVAAGKKRVIVIGISVGLSAPFVAGQMDCCMNNTAVFLPVLVGFNPVSMARNDPIEDWSSTFRQVAERMQKMQEKQKAFVLNPAIGPEGLSGSSRMKGGSATKILLETLLLAAHKTVDQGIAASQRCLLEILRTFERAHQVTYSQSPKIATLMKSVSTSLEKKGHVYLVGWQTLGIIAIMDGVECIHTFGADFRDVRGFLIGDHSDMFNQKAELTNQGPQFTFSQEDFLTSILPSLTEIDTVVFIFTLDDNLTEVQTIVEQVKEKTNHIQALAHSTVGQTLLIPLKKLFPSIISITWPLLFFEYEGNFIQKFQRELSTKWVLNTVSTGAHVLLGKILQNHMLDLRISNSKLFWRALAMLQRFSGQSKARCIESLLRAIHFPQPLSDDIRAAPISCHVQVAHEKEQVIPIALLSLLFRCSITEAQAHLAAAPSVCEAVRSALAGPGQKRTADPLEILEPDVQ

SEQ ID NO: 34772 - protein, 150 aa, Homo sapiens
  Payload ID: 6869
  Gene Symbol: GCKR
  Gene Name: glucokinase (hexokinase 4) regulator
  Uniprot ID: Q14397
  ENSP ID: ENSP00000398303
MPGTKRFQHVIETPEPGKWELSGYEAAVPITEKSNPLTQDLDKADAENIVRLLGQCDAEIFQEEGQALSTYQRLYSESILTTMVQVAGKVQEVLKEPDGGLVVLSGGGTSGRMAFLMSVSFNQLMKGLGQKPLYTYLIAGGDRWLPGRRE

SEQ ID NO: 34773 - protein, 227 aa, Homo sapiens
  Payload ID: 6869
  Gene Symbol: GCKR
  Gene Name: glucokinase (hexokinase 4) regulator
  ENSP ID: ENSP00000399463
PITEKSNPLTQDLDKADAENIVRLLGQCDAEIFQEEGQALSTYQRLYSESILTTMVQVAGKVQEVLKEPDGGLVVLSGGGTSGRMAFLMSVSFNQLMKGLGQKPLYTYLIAGGDRSVVASREGTEDSALHGIEELKKVAAGKKRVIVIGISVGLSAPFVAGQMDCCMNNTAVFLPVLVGFNPVSMARHPFPPPRILRSLTVFPSLRAPHYQITSLLFSMSVVTLISE

SEQ ID NO: 34774 - protein, 189 aa, Homo sapiens
  Payload ID: 6869
  Gene Symbol: GCKR
  Gene Name: glucokinase (hexokinase 4) regulator
  ENSP ID: ENSP00000416917
  MOD_RES (1)..(1): Any amino acid
XRAHQVTYSQSPKIATLMKSVSTSLEKKGHVYLVGWQTLGIIAIMDGVECIHTFGADFRDVRGFLIGDHSDMFNQKAELTNQGPQFTFSQEDFLTSILPSLTEIDTVVFIFTLDDNLTEVQTIVEQVKEKTNHIQALAHSTVGQTLLIPLKKLFPSIISITWPLLFFEYEGNFIQRSGFSTLPRLFANS

SEQ ID NO: 34775 - protein, 552 aa, Homo sapiens
  Payload ID: 6870
  Gene Symbol: GNS
  Gene Name: glucosamine (N-acetyl)-6-sulfatase
  Uniprot ID: P15586
  ENSP ID: ENSP00000258145
MRLLPLAPGRLRRGSPRHLPSCSPALLLLVLGGCLGVFGVAAGTRRPNVVLLLTDDQDEVLGGMTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 34776 - protein, 496 aa, Homo sapiens
  Payload ID: 6870
  Gene Symbol: GNS
  Gene Name: glucosamine (N-acetyl)-6-sulfatase
  ENSP ID: ENSP00000413130
MDNYLLLQTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 34777 - protein, 303 aa, Homo sapiens
  Payload ID: 6870
  Gene Symbol: GNS
  Gene Name: glucosamine (N-acetyl)-6-sulfatase
  ENSP ID: ENSP00000437782
  MOD_RES (1)..(1): Any amino acid
XYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPT

SEQ ID NO: 34778 - protein, 584 aa, Homo sapiens
  Payload ID: 6870
  Gene Symbol: GNS
  Gene Name: glucosamine (N-acetyl)-6-sulfatase
  ENSP ID: ENSP00000438497
MRLLPLAPGRLRRGSPRHLPSCSPALLLLVLGGCLGVFGVAAGTRRPNVVLLLTDDQDEVLGGMAFSEYSTTNCQTGLQGEELGQEHLRTYLEPSRTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 34779 - protein, 532 aa, Homo sapiens
  Payload ID: 6870
  Gene Symbol: GNS
  Gene Name: glucosamine (N-acetyl)-6-sulfatase
  Uniprot ID: P15586
  ENSP ID: ENSP00000444819
MRLLPLAPGRLRRGSPRHLPSCSPALLLLVLGGCLGVFGVAAGTRRPNVVLLLTDDQDEVLGGMYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 34780 - protein, 247 aa, Homo sapiens
  Payload ID: 6870
  Gene Symbol: GNS
  Gene Name: glucosamine (N-acetyl)-6-sulfatase
  ENSP ID: ENSP00000445055
MGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFY

SEQ ID NO: 34781 - protein, 722 aa, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENSP ID: ENSP00000367134
MEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 34782 - protein, 753 aa, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENSP ID: ENSP00000379839
METYGYLQRESCFQGPHELYFKNLSKRNKQIMEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 34783 - protein, 648 aa, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENSP ID: ENSP00000414760
MEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 34784 - protein, 717 aa, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENSP ID: ENSP00000437765
MPIGDCSVAAKPRKQLLCSLFQTTLGYRARASGWKPMVICRGSHAFKDLINTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 34785 - protein, 722 aa, Homo sapiens; identical to SEQ ID NO: 34781
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENSP ID: ENSP00000439155

SEQ ID NO: 34786 - protein, 612 aa, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENSP ID: ENSP00000445117
MIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 34787 - protein, 289 aa, Homo sapiens
  Payload ID: 6872
  Gene Symbol: GNPDA1
  Gene Name: glucosamine-6-phosphate deaminase 1
  Uniprot ID: P46926
  ENSP ID: ENSP00000311876
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 34788 - protein, 290 aa, Homo sapiens
  Payload ID: 6872
  Gene Symbol: GNPDA1
  Gene Name: glucosamine-6-phosphate deaminase 1
  ENSP ID: ENSP00000421524
MKLIILEHYSQASEWAAKYIRNRIIQFNPGPEKYFTLGLPTGAFLDGEGAVDKGGESRQQGPGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPL

SEQ ID NO: 34789 - protein, 138 aa, Homo sapiens
  Payload ID: 6872
  Gene Symbol: GNPDA1
  Gene Name: glucosamine-6-phosphate deaminase 1
  ENSP ID: ENSP00000422173
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGI

SEQ ID NO: 34790 - protein, 289 aa, Homo sapiens; identical to SEQ ID NO: 34787
  Payload ID: 6872
  Gene Symbol: GNPDA1
  Gene Name: glucosamine-6-phosphate deaminase 1
  Uniprot ID: P46926
  ENSP ID: ENSP00000423485

SEQ ID NO: 34791 - protein, 274 aa, Homo sapiens
  Payload ID: 6872
  Gene Symbol: GNPDA1
  Gene Name: glucosamine-6-phosphate deaminase 1
  ENSP ID: ENSP00000423494
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKAPPQVNRKGYIYSTNFGI

SEQ ID NO: 34792 - protein, 289 aa, Homo sapiens; identical to SEQ ID NO: 34787
  Payload ID: 6872
  Gene Symbol: GNPDA1
  Gene Name: glucosamine-6-phosphate deaminase 1
  Uniprot ID: P46926
  ENSP ID: ENSP00000423674

SEQ ID NO: 34793 - protein, 289 aa, Homo sapiens; identical to SEQ ID NO: 34787
  Payload ID: 6872
  Gene Symbol: GNPDA1
  Gene Name: glucosamine-6-phosphate deaminase 1
  Uniprot ID: P46926
  ENSP ID: ENSP00000424275

SEQ ID NO: 34794 - protein, 160 aa, Homo sapiens
  Payload ID: 6872
  Gene Symbol: GNPDA1
  Gene Name: glucosamine-6-phosphate deaminase 1
  ENSP ID: ENSP00000424537
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVK

SEQ ID NO: 34795 - protein, 237 aa, Homo sapiens
  Payload ID: 6872
  Gene Symbol: GNPDA1
  Gene Name: glucosamine-6-phosphate deaminase 1
  ENSP ID: ENSP00000424625
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKAIEEGVNHMWTVSAFQQHPRTVFVCDEDATLELKVKTVKYFKGLMLVHNKLVDPLYS

SEQ ID NO: 34796 - protein, 29 aa, Homo sapiens
  Payload ID: 6872
  Gene Symbol: GNPDA1
  Gene Name: glucosamine-6-phosphate deaminase 1
  ENSP ID: ENSP00000426583
MKLIILEHYSQASEWAAKYIRNRIIQFNP

SEQ ID NO: 34797 - protein, 276 aa, Homo sapiens
  Payload ID: 6873
  Gene Symbol: GNPDA2
  Gene Name: glucosamine-6-phosphate deaminase 2
  Uniprot ID: Q8TDQ7
  ENSP ID: ENSP00000295448
MRLVILDNYDLASEWAAKYICNRIIQFKPGQDRYFTLGLPTGSTPLGCYKKLIEYHKNGHLSFKYVKTFNMDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGLMHVHNKLVDPLFSMKDGN

SEQ ID NO: 34798 - protein, 259 aa, Homo sapiens
  Payload ID: 6873
  Gene Symbol: GNPDA2
  Gene Name: glucosamine-6-phosphate deaminase 2
  Uniprot ID: Q8TDQ7
  ENSP ID: ENSP00000424061
MRLVILDNYDLASEWAAKYICNRIIQFKPGQDRYFTLGLPTGSTPLGCYKKLIEYHKNGHLSFKYVKTFNMDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGEH

SEQ ID NO: 34799 - protein, 242 aa, Homo sapiens
  Payload ID: 6873
  Gene Symbol: GNPDA2
  Gene Name: glucosamine-6-phosphate deaminase 2
  Uniprot ID: Q8TDQ7
  ENSP ID: ENSP00000425868
MRLVILDNYDLASEWAAKYICNRIIQFKPGQDRYFTLGLPTGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGLMHVHNKLVDPLFSMKDGN

SEQ ID NO: 34800 - protein, 206 aa, Homo sapiens
  Payload ID: 6873
  Gene Symbol: GNPDA2
  Gene Name: glucosamine-6-phosphate deaminase 2
  Uniprot ID: Q8TDQ7
  ENSP ID: ENSP00000427423
MDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGLMHVHNKLVDPLFSMKDGN

SEQ ID NO: 34801 - protein, 117 aa, Homo sapiens
  Payload ID: 6873
  Gene Symbol: GNPDA2
  Gene Name: glucosamine-6-phosphate deaminase 2
  ENSP ID: ENSP00000476853
  MOD_RES (1)..(1): Any amino acid
XGDLSKVPTMALTVGVGTVMDAREVMILITGAHKAFALYKAIEEGVNHMWTVSAFQQHPRTIFVCDEDATLELRVKTVKYFKEMALSYHKLIQENYLLNSVQGCASKARKKFATVWA

SEQ ID NO: 34802 - protein, 63 aa, Homo sapiens
  Payload ID: 6873
  Gene Symbol: GNPDA2
  Gene Name: glucosamine-6-phosphate deaminase 2
  ENSP ID: ENSP00000477137
AIEEGVNHMWTVSAFQQHPRTIFVCDEDATLELRVKTVKYFKEMALSYHKLIQENYLLNSVQG

SEQ ID NO: 34803 - protein, 184 aa, Homo sapiens
  Payload ID: 6874
  Gene Symbol: GNPNAT1
  Gene Name: glucosamine-phosphate N-acetyltransferase 1
  Uniprot ID: Q96EK6
  ENSP ID: ENSP00000216410
MKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKRGRVEDVVVSDECRGKQLGKLLLSTLTLLSKKLNCYKITLECLPQNVGFYKKFGYTVSEENYMCRRFLK

SEQ ID NO: 34804 - protein, 163 aa, Homo sapiens
  Payload ID: 6874
  Gene Symbol: GNPNAT1
  Gene Name: glucosamine-phosphate N-acetyltransferase 1
  ENSP ID: ENSP00000452032
MKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKRGRVEDVVVSDECRGKQLGKLLLSTLTLLSKKLNCYKITLECLPQNVG

SEQ ID NO: 34805 - protein, 113 aa, Homo sapiens
  Payload ID: 6874
  Gene Symbol: GNPNAT1
  Gene Name: glucosamine-phosphate N-acetyltransferase 1
  ENSP ID: ENSP00000452310
MKSFEHMKKSGDYYVTVVEDVTLGQIVATATLIIEHKFIHSCAKRGRVEDVVVSDECRGKQLGKLLLSTLTLLSKKLNCYKITLECLPQNVGFYKKFGYTVSEENYMCRRFLK

SEQ ID NO: 34806 - protein, 428 aa, Homo sapiens
  Payload ID: 6875
  Gene Symbol: GCNT1
  Gene Name: glucosaminyl (N-acetyl) transferase 1, core 2
  Uniprot ID: Q02742
  ENSP ID: ENSP00000365920
MLRTLLRRRLFSYPTKYYFMVLVLSLITFSVLRIHQKPEFVSVRHLELAGENPSSDINCTKVLQGDVNEIQKVKLEILTVKFKKRPRWTPDDYINMTSDCSSFIKRRKYIVEPLSKEEAEFPIAYSIVVHHKIEMLDRLLRAIYMPQNFYCIHVDTKSEDSYLAAVMGIASCFSNVFVASRLESVVYASWSRVQADLNCMKDLYAMSANWKYLINLCGMDFPIKTNLEIVRKLKLLMGENNLETERMPSHKEERWKKRYEVVNGKLTNTGTVKMLPPLETPLFSGSAYFVVSREYVGYVLQNEKIQKLMEWAQDTYSPDEYLWATIQRIPEVPGSLPASHKYDLSDMQAVARFVKWQYFEGDVSKGAPYPPCDGVHVRSVCIFGAGDLNWMLRKHHLFANKFDVDVDLFAIQCLDEHLRHKALETLKH

SEQ ID NO: 34807 - protein, 428 aa, Homo sapiens; identical to SEQ ID NO: 34806
  Payload ID: 6875
  Gene Symbol: GCNT1
  Gene Name: glucosaminyl (N-acetyl) transferase 1, core 2
  Uniprot ID: Q02742
  ENSP ID: ENSP00000390703

SEQ ID NO: 34808 - protein, 428 aa, Homo sapiens; identical to SEQ ID NO: 34806
  Payload ID: 6875
  Gene Symbol: GCNT1
  Gene Name: glucosaminyl (N-acetyl) transferase 1, core 2
  Uniprot ID: Q02742
  ENSP ID: ENSP00000415454

SEQ ID NO: 34809 - protein, 402 aa, Homo sapiens
  Payload ID: 6876
  Gene Symbol: GCNT2
  Gene Name: glucosaminyl (N-acetyl) transferase 2, I-branching enzyme (I blood group)
  Uniprot ID: Q8NFS9
  ENSP ID: ENSP00000265012
MNFWRYCFFAFTLLSVVIFVRFYSSQLSPPKSYEKLNSSSERYFRKTACNHALEKMPVFLWENILPSPLRSVPCKDYLTQNHYITSPLSEEEAAFPLAYVMVIHKDFDTFERLFRAIYMPQNVYCVHVDEKAPAEYKESVRQLLSCFQNAFIASKTESVVYAGISRLQADLNCLKDLVASEVPWKYVINTCGQDFPLKTNREIVQHLKGFKGKNITPGVLPPDHAIKRTKYVHQEHTDKGGFFVKNTNILKTSPPHQLTIYFGTAYVALTRDFVDFVLRDQRAIDLLQWSKDTYSPDEHFWVTLNRVSGVPGSMPNASWTGNLRAIKWSDMEDRHGGCHGHYVHGICIYGNGDLKWLVNSPSLFANKFELNTYPLTVECLELRHRERTLNQSETAIQPSWYF

SEQ ID NO: 34810 - protein, 400 aa, Homo sapiens
  Payload ID: 6876
  Gene Symbol: GCNT2
  Gene Name: glucosaminyl (N-acetyl) transferase 2, I-branching enzyme (I blood group)
  Uniprot ID: Q06430
  ENSP ID: ENSP00000314844
MPLSMRYLFIISVSSVIIFIVFSVFNFGGDPSFQRLNISDPLRLTQVCTSFINGKTRFLWKNKLMIHEKSSCKEYLTQSHYITAPLSKEEADFPLAYIMVIHHHFDTFARLFRAIYMPQNIYCVHVDEKATTEFKDAVEQLLSCFPNAFLASKMEPVVYGGISRLQADLNCIRDLSAFEVSWKYVINTCGQDFPLKTNKEIVQYLKGFKGKNITPGVLPPAHAIGRTKYVHQEHLGKELSYVIRTTALKPPPPHNLTIYFGSAYVALSREFANFVLHDPRAVDLLQWSKDTFSPDEHFWVTLNRIPGVPGSMPNASWTGNLRAIKWSDMEDRHGGCHGHYVHGICIYGNGDLKWLVNSPSLFANKFELNTYPLTVECLELRHRERTLNQSETAIQPSWYF

SEQ ID NO: 34811 - protein, 402 aa, Homo sapiens
  Payload ID: 6876
  Gene Symbol: GCNT2
  Gene Name: glucosaminyl (N-acetyl) transferase 2, I-branching enzyme (I blood group)
  Uniprot ID: Q8N0V5
  ENSP ID: ENSP00000368917
MMGSWKHCLFSASLISALIFVFVYNTELWENKRFLRAALSNASLLAEACHQIFEGKVFYPTENALKTTLDEATCYEYMVRSHYVTETLSEEEAGFPLAYTVTIHKDFGTFERLFRAIYMPQNVYCVHLDQKATDAFKGAVKQLLSCFPNAFLASKKESVVYGGISRLQADLNCLEDLVASEVPWKYVINTCGQDFPLKTNREIVQYLKGFKGKNITPGVLPPDHAVGRTKYVHQELLNHKNSYVIKTTKLKTPPPHDMVIYFGTAYVALTRDFANFVLQDQLALDLLSWSKDTYSPDEHFWVTLNRIPGVPGSMPNASWTGNLRAIKWSDMEDRHGGCHGHYVHGICIYGNGDLKWLVNSPSLFANKFELNTYPLTVECLELRHRERTLNQSETAIQPSWYF

SEQ ID NO: 34812 - protein, 116 aa, Homo sapiens
  Payload ID: 6876
  Gene Symbol: GCNT2
  Gene Name: glucosaminyl (N-acetyl) transferase 2, I-branching enzyme (I blood group)
  ENSP ID: ENSP00000386321
MEGKIFGSSFLCPTRCDQLLLPGVPGSMPNASWTGNLRAIKWSDMEDRHGGCHGHYVHGICIYGNGDLKWLVNSPSLFANKFELNTYPLTVECLELRHRERTLNQSETAIQPSWYF

SEQ ID NO: 34813 - protein, 402 aa, Homo sapiens; identical to SEQ ID NO: 34811
  Payload ID: 6876
  Gene Symbol: GCNT2
  Gene Name: glucosaminyl (N-acetyl) transferase 2, I-branching enzyme (I blood group)
  Uniprot ID: Q8N0V5
  ENSP ID: ENSP00000419411

SEQ ID NO: 34814 - protein, 438 aa, Homo sapiens
  Payload ID: 6877
  Gene Symbol: GCNT3
  Gene Name: glucosaminyl (N-acetyl) transferase 3, mucin type
  Uniprot ID: O95395
  ENSP ID: ENSP00000379377
MVQWKRLCQLHYLWALGCYMLLATVALKLSFRLKCDSDHLGLESRESQSQYCRNILYNFLKLPAKRSINCSGVTRGDQEAVLQAILNNLEVKKKREPFTDTHYLSLTRDCEHFKAERKFIQFPLSKEEVEFPIAYSMVIHEKIENFERLLRAVYAPQNIYCVHVDEKSPETFKEAVKAIISCFPNVFIASKLVRVVYASWSRVQADLNCMEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 34815 - protein, 438 aa, Homo sapiens; identical to SEQ ID NO: 34814
  Payload ID: 6877
  Gene Symbol: GCNT3
  Gene Name: glucosaminyl (N-acetyl) transferase 3, mucin type
  Uniprot ID: O95395
  ENSP ID: ENSP00000452741

SEQ ID NO: 34816 - protein, 87 aa, Homo sapiens
  Payload ID: 6877
  Gene Symbol: GCNT3
  Gene Name: glucosaminyl (N-acetyl) transferase 3, mucin type
  ENSP ID: ENSP00000453453
MVQWKRLCQLHYLWALGCYMLLATVALKLSFRLKCDSDHLGLESRESQSQYCRNILYNFLKLPAKRSINCSGVTRGDQEAVLQAILN

SEQ ID NO: 34817 - protein, 153 aa, Homo sapiens
  Payload ID: 6877
  Gene Symbol: GCNT3
  Gene Name: glucosaminyl (N-acetyl) transferase 3, mucin type
  ENSP ID: ENSP00000453774
MVQWKRLCQLHYLWALGCYMLLATVALKLSFRLKCDSDHLGLESRESQSQYCRNILYNFLKLPAKRSINCSGVTRGDQEAVLQAILNNLEVKKKREPFTDTHYLSLTRDCEHFKAERKFIQFPLSKEEVEFPIAYSMVIHEKIENFERLLRAV

SEQ ID NO: 34818 - protein, 53 aa, Homo sapiens
  Payload ID: 6877
  Gene Symbol: GCNT3
  Gene Name: glucosaminyl (N-acetyl) transferase 3, mucin type
  ENSP ID: ENSP00000453928
MVQWKRLCQLHYLWALGCYMLLATVALKLSFRLKCDSDHLGLESRESQSQYCR

SEQ ID NO: 34819 - protein, 453 aa, Homo sapiens
  Payload ID: 6878
  Gene Symbol: GCNT4
  Gene Name: glucosaminyl (N-acetyl) transferase 4, core 2
  Uniprot ID: Q9P109
  ENSP ID: ENSP00000317027
MKIFKCYFKHTLQQKVFILFLTLWLLSLLKLLNVRRLFPQKDIYLVEYSLSTSPFVRNRYTHVKDEVRYEVNCSGIYEQEPLEIGKSLEIRRRDIIDLEDDDVVAMTSDCDIYQTLRGYAQKLVSKEEKSFPIAYSLVVHKDAIMVERLIHAIYNQHNIYCIHYDRKAPDTFKVAMNNLAKCFSNIFIASKLEAVEYAHISRLQADLNCLSDLLKSSIQWKYVINLCGQDFPLKSNFELVSELKKLNGANMLETVKPPNSKLERFTYHHELRRVPYEYVKLPIRTNISKEAPPHNIQIFVGSAYFVLSQAFVKYIFNNSIVQDFFAWSKDTYSPDEHFWATLIRVPGIPGEISRSAQDVSDLQSKTRLVKWNYYEGFFYPSCTGSHLRSVCIYGAAELRWLIKDGHWFANKFDSKVDPILIKCLAEKLEEQQRDWITLPSEKLFMDRNLTTTS

SEQ ID NO: 34820 - protein, 308 aa, Homo sapiens
  Payload ID: 6879
  Gene Symbol: GCNT7
  Gene Name: glucosaminyl (N-acetyl) transferase family member 7
  Uniprot ID: Q6ZNI0
  ENSP ID: ENSP00000243913
MFVQLLRAIYVPQNVYCIHVDEKAPMKYKTAVQTLVNCFENVFISSKTEKVAYAGFTRLQADINCMKVLVHSKFQWNYVINLCGQDFPIKTNREIIHYIRSKWSDKNITPGVIQPLHIKSKTSQSHLEFVPKGSIYAPPNNRFKDKPPHNLTIYFGSAYYVLTRKFVEFILTDIHAKDMLQWSKDIRSPEQHYWVTLNRLKDAPGATPNAGWEGNVRAIKRKSEEGNVHDGCKGRYVEDICVYGPGDLPWLIQSPSLFANKFEPSTDPLVVTCLERRHRLQVLRQAEVPIEPHWHFQQQSHFNMRLNR

SEQ ID NO: 34821 - protein, 429 aa, Homo sapiens
  Payload ID: 6879
  Gene Symbol: GCNT7
  Gene Name: glucosaminyl (N-acetyl) transferase family member 7
  ENSP ID: ENSP00000482600
MSQLRATKSGLVVRAVICIFIFLYLRNPTPAESEEEPAQPEVVECGFYPDELCSALFEGKGAAPIAKFCKTPHKSEIHAHLHTPGNCSRISRGLHFITRPLSAEEGDFSLAYIITIHKELAMFVQLLRAIYVPQNVYCIHVDEKAPMKYKTAVQTLVNCFENVFISSKTEKVAYAGFTRLQADINCMKVLVHSKFQWNYVINLCGQDFPIKTNREIIHYIRSKWSDKNITPGVIQPLHIKSKTSQSHLEFVPKGSIYAPPNNRFKDKPPHNLTIYFGSAYYVLTRKFVEFILTDIHAKDMLQWSKDIRSPEQHYWVTLNRLKDAPGATPNAGWEGNVRAIKRKSEEGNVHDGCKGRYVEDICVYGPGDLPWLIQSPSLFANKFEPSTDPLVVTCLERRHRLQVLRQAEVPIEPHWHFQQQSHFNMRLNR

SEQ ID NO: 34822 - protein, 346 aa, Homo sapiens
  Payload ID: 6880
  Gene Symbol: G6PC3
  Gene Name: glucose 6 phosphatase, catalytic, 3
  Uniprot ID: Q9BUM1
  ENSP ID: ENSP00000269097
MESTLGAGIVIAEALQNQLAWLENVWLWITFLGDPKILFLFYFPAAYYASRRVGIAVLWISLITEWLNLIFKWFLFGDRPFWWVHESGYYSQAPAQVHQFPSSCETGPGSPSGHCMITGAALWPIMTALSSQVATRARSRWVRVMPSLAYCTFLLAVGLSRIFILAHFPHQVLAGLITGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 34823 - protein, 69 aa, Homo sapiens
  Payload ID: 6880
  Gene Symbol: G6PC3
  Gene Name: glucose 6 phosphatase, catalytic, 3
  ENSP ID: ENSP00000465111
  MOD_RES (1)..(1): Any amino acid
XALSSQVATRARRRCPGLADDSPSAYGAGAKLLWVDCTGPHARHQPHLLDPLYTGPGSFLVHQPSLQVV

SEQ ID NO: 34824 - protein, 73 aa, Homo sapiens
  Payload ID: 6880
  Gene Symbol: G6PC3
  Gene Name: glucose 6 phosphatase, catalytic, 3
  ENSP ID: ENSP00000466821
MESTLGAGIVIAEALQNQLAWLENVWLWITFLGDPKILFLFYFPAAYYASRRVGIAVLWISLITEWLNLIFKW

SEQ ID NO: 34825 - protein, 73 aa, Homo sapiens; identical to SEQ ID NO: 34824
  Payload ID: 6880
  Gene Symbol: G6PC3
  Gene Name: glucose 6 phosphatase, catalytic, 3
  ENSP ID: ENSP00000466983

SEQ ID NO: 34826 - protein, 72 aa, Homo sapiens
  Payload ID: 6880
  Gene Symbol: G6PC3
  Gene Name: glucose 6 phosphatase, catalytic, 3
  ENSP ID: ENSP00000467624
MESTLGAGIVIAEALQNQLAWLENVWLWITFLGDPKILFLFYFPAAYYASRRVGIAVLWISLITEWLNLIFK

SEQ ID NO: 34827 - protein, 243 aa, Homo sapiens
  Payload ID: 6880
  Gene Symbol: G6PC3
  Gene Name: glucose 6 phosphatase, catalytic, 3
  ENSP ID: ENSP00000468677
MESTLGAGIVIAEALQNQLAWLENVWLWITFLGDPKILFLFYFPAAYYASRRVGIAVLWISLITEWLNLIFKWFLFGDRPFWWVHESGYYSQAPAQVATRARSRWVRVMPSLAYCTFLLAVGLSRIFILAHFPHQVLAGLITGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLG

SEQ ID NO: 34828 - protein, 357 aa, Homo sapiens
  Payload ID: 6881
  Gene Symbol: G6PC
  Gene Name: glucose-6-phosphatase, catalytic subunit
  Uniprot ID: P35575
  ENSP ID: ENSP00000253801
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLAQVLGQPHKKSL

SEQ ID NO: 34829 - protein, 176 aa, Homo sapiens
  Payload ID: 6881
  Gene Symbol: G6PC
  Gene Name: glucose-6-phosphatase, catalytic subunit
  Uniprot ID: P35575
  ENSP ID: ENSP00000465958
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGKDKADLQISVLECHFVVGILGCAAECLSVTNLPCCSFSSSSCCWSPVRHCCCRNFQPHPQHL

SEQ ID NO: 34830 - protein, 163 aa, Homo sapiens
  Payload ID: 6881
  Gene Symbol: G6PC
  Gene Name: glucose-6-phosphatase, catalytic subunit
  ENSP ID: ENSP00000466202
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRHCCCRNFQPHPQHL

SEQ ID NO: 34831 - protein, 102 aa, Homo sapiens
  Payload ID: 6882
  Gene Symbol: G6PC2
  Gene Name: glucose-6-phosphatase, catalytic, 2
  Uniprot ID: Q9NQR9
  ENSP ID: ENSP00000282075
MDFLHRNGVLIIQHLQKDYRAYYTFLNFMSNVGDPRNIFFIYFPLCFQFNQTVGTKMIWVAVIGDWLNLIFKWKSIWPCNGRILCLVCHGNRCPEPHCLWDG

SEQ ID NO: 34832 - protein, 355 aa, Homo sapiens
  Payload ID: 6882
  Gene Symbol: G6PC2
  Gene Name: glucose-6-phosphatase, catalytic, 2
  Uniprot ID: Q9NQR9
  ENSP ID: ENSP00000364512
MDFLHRNGVLIIQHLQKDYRAYYTFLNFMSNVGDPRNIFFIYFPLCFQFNQTVGTKMIWVAVIGDWLNLIFKWILFGHRPYWWVQETQIYPNHSSPCLEQFPTTCETGPGSPSGHAMGASCVWYVMVTAALSHTVCGMDKFSITLHRLTWSFLWSVFWLIQISVCISRVFIATHFPHQVILGVIGGMLVAEAFEHTPGIQTASLGTYLKTNLFLFLFAVGFYLLLRVLNIDLLWSVPIAKKWCANPDWIHIDTTPFAGLVRNLGVLFGLGFAINSEMFLLSCRGGNNYTLSFRLLCALTSLTILQLYHFLQIPTHEEHLFYVLSFCKSASIPLTVVAFIPYSVHMLMKQSGKKSQ

SEQ ID NO: 34833 - protein, 80 aa, Homo sapiens
  Payload ID: 6882
  Gene Symbol: G6PC2
  Gene Name: glucose-6-phosphatase, catalytic, 2
  ENSP ID: ENSP00000392183
MDFLHRNGVLIIQHLQKDYRAYYTFLNFMSNVGDPRNIFFIYFPLCFQFNQTVGTKMIWVAVIGDWLNLIFKWHAGGRGL

SEQ ID NO: 34834 - protein, 154 aa, Homo sapiens
  Payload ID: 6882
  Gene Symbol: G6PC2
  Gene Name: glucose-6-phosphatase, catalytic, 2
  Uniprot ID: Q9NQR9
  ENSP ID: ENSP00000396939
MDFLHRNGVLIIQHLQKDYRAYYTFLNFMSNVGDPRNIFFIYFPLCFQFNQTVGTKMIWVAVIGDWLNLIFKWILFGHRPYWWVQETQIYPNHSSPCLEQFPTTCETGPGSPSGHAMGASCVWYVMVTAALSHTVCGMDKFSITLHRHAGGRGL

SEQ ID NO: 34835 - protein, 80 aa, Homo sapiens; identical to SEQ ID NO: 34833
  Payload ID: 6882
  Gene Symbol: G6PC2
  Gene Name: glucose-6-phosphatase, catalytic, 2
  ENSP ID: ENSP00000479442

SEQ ID NO: 34836 - protein, 154 aa, Homo sapiens; identical to SEQ ID NO: 34834
  Payload ID: 6882
  Gene Symbol: G6PC2
  Gene Name: glucose-6-phosphatase, catalytic, 2
  Uniprot ID: Q9NQR9
  ENSP ID: ENSP00000481098

SEQ ID NO: 34837 - protein, 355 aa, Homo sapiens; identical to SEQ ID NO: 34832
  Payload ID: 6882
  Gene Symbol: G6PC2
  Gene Name: glucose-6-phosphatase, catalytic, 2
  Uniprot ID: Q9NQR9
  ENSP ID: ENSP00000482583

SEQ ID NO: 34838 - protein, 102 aa, Homo sapiens; identical to SEQ ID NO: 34831
  Payload ID: 6882
  Gene Symbol: G6PC2
  Gene Name: glucose-6-phosphatase, catalytic, 2
  Uniprot ID: Q9NQR9
  ENSP ID: ENSP00000483899

SEQ ID NO: 34839 - protein, 561 aa, Homo sapiens
  Payload ID: 6883
  Gene Symbol: G6PD
  Gene Name: glucose-6-phosphate dehydrogenase
  Uniprot ID: P11413
  ENSP ID: ENSP00000358633
MAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRGPGRQGGSGSESCSLSLGSLVWGPHALEPGEQGGELRRALASSVPRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 34840 - protein, 545 aa, Homo sapiens
  Payload ID: 6883
  Gene Symbol: G6PD
  Gene Name: glucose-6-phosphate dehydrogenase
  Uniprot ID: P11413
  ENSP ID: ENSP00000377192
MGRRGSAPGNGRTLRGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 34841 - protein, 515 aa, Homo sapiens [sequence omitted]

SEQ ID NO: 34842 - protein, 256 aa, Homo sapiens
  Payload ID: 6883
  Gene Symbol: G6PD
  Gene Name: glucose-6-phosphate dehydrogenase
  ENSP ID: ENSP00000394690
MAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGII

SEQ ID NO: 34843 - protein, 338 aa, Homo sapiens
  Payload ID: 6883
  Gene Symbol: G6PD
  Gene Name: glucose-6-phosphate dehydrogenase
  ENSP ID: ENSP00000395599
MAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIRGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATF

SEQ ID NO: 34844 - protein, 320 aa, Homo sapiens
  Payload ID: 6883
  Gene Symbol: G6PD
  Gene Name: glucose-6-phosphate dehydrogenase
  ENSP ID: ENSP00000400648
MAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIRGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEAT

SEQ ID NO: 34845 - protein, 515 aa, Homo sapiens [sequence omitted]

SEQ ID NO: 34846 - protein, 558 aa, Homo sapiens
  Payload ID: 6884
  Gene Symbol: GPI
  Gene Name: glucose-6-phosphate isomerase
  Uniprot ID: P06744
  ENSP ID: ENSP00000348877
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 34847 - protein, 569 aa, Homo sapiens
  Payload ID: 6884
  Gene Symbol: GPI
  Gene Name: glucose-6-phosphate isomerase
  Uniprot ID: P06744
  ENSP ID: ENSP00000405573
MVALCSLQHLGSSDPRALPTLPTATSGQRPAKRRRKSPAMAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 34848 - protein, 110 aa, Homo sapiens
  Payload ID: 6884
  Gene Symbol: GPI
  Gene Name: glucose-6-phosphate isomerase
  ENSP ID: ENSP00000464797
MVALCSLQHLGSSDPRALPTLPTATSGQRPAKRRRKSPAMAALTRDPQFQKLQQWYREHRSELNLRRLFDANKDRFNHFSLTLNTNHGHILVDYSKNLVTEDVMRMLVDL

SEQ ID NO: 34849 - protein, 10 aa, Homo sapiens
  Payload ID: 6884
  Gene Symbol: GPI
  Gene Name: glucose-6-phosphate isomerase
  ENSP ID: ENSP00000464798
  MOD_RES (1)..(1): Any amino acid
XRPAKRRRKR

SEQ ID NO: 34850 - protein, 573 aa, Homo sapiens
  Payload ID: 6884
  Gene Symbol: GPI
  Gene Name: glucose-6-phosphate isomerase
  ENSP ID: ENSP00000465858
TSGQRPAKRRRKSPAMAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 34851 - protein, 146 aa, Homo sapiens
  Payload ID: 6884
  Gene Symbol: GPI
  Gene Name: glucose-6-phosphate isomerase
  ENSP ID: ENSP00000466191
MVALCSLQHLGSSDPRALPTLPTATSGQRPAKRRRKSPAMAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRS

SEQ ID NO: 34852 - protein, 162 aa, Homo sapiens
  Payload ID: 6884
  Gene Symbol: GPI
  Gene Name: glucose-6-phosphate isomerase
  ENSP ID: ENSP00000466851
MAALTRDPQFQKLQQWYREHRSELNLRRLFDANKDRFNHFSLTLNTNHGHILVDYSKNLVTEDVMRMLVDLAKSRGVEAARERMFNGEKINYTERVRSGDWKGYTGKTITDVINIGIGGSDLGPLMVTEALKPYSSGGPRVWYVSNIDGTHIAKTLAQLNPE

SEQ ID NO: 34853 - protein, 159 aa, Homo sapiens
  Payload ID: 6884
  Gene Symbol: GPI
  Gene Name: glucose-6-phosphate isomerase
  ENSP ID: ENSP00000467221
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGG

SEQ ID NO: 34854 - protein, 166 aa, Homo sapiens
  Payload ID: 6884
  Gene Symbol: GPI
  Gene Name: glucose-6-phosphate isomerase
  ENSP ID: ENSP00000467590
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQGPLMVTEALKPYSSGGPRVWYVSNIDGTHIAK

SEQ ID NO: 34855 - protein, 474 aa, Homo sapiens
  Payload ID: 6884
  Gene Symbol: GPI
  Gene Name: glucose-6-phosphate isomerase
  ENSP ID: ENSP00000467670
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKSGAGKAAG

SEQ ID NO: 34856 - protein, 161 aa, Homo sapiens
  Payload ID: 6884
  Gene Symbol: GPI
  Gene Name: glucose-6-phosphate isomerase
  ENSP ID: ENSP00000468201
MAALTRDPQFQKLQQWYREHRSELNLRRLFDANKDRFNHFSLTLNTNHGHILVDYSKNLVTEDVMRMLVDLAKSRGVEAARERMFNGEKINYTEDVMPEVNKVLDKMKSFCQRVRSGDWKGYTGKTITDVINIGIGGSDLGPLMVTEALKPYSSGGPRVWY

SEQ ID NO: 34857 - protein, 133 aa, Homo sapiens
  Payload ID: 6884
  Gene Symbol: GPI
  Gene Name: glucose-6-phosphate isomerase
  ENSP ID: ENSP00000468298
MVALCSLQHLGSSDPRALPTLPTATSGQRPAKRRRKSPAMAALTRDPQFQKLQQWYREHRSELNLRRLFDANKDRFNHFSLTLNTNHGHILVDYSKNLVTEDVMRMLVDLAKSRGVEAARERMFNGEKINYTE

SEQ ID NO: 34858 - protein, 268 aa, Homo sapiens
  Payload ID: 6884
  Gene Symbol: GPI
  Gene Name: glucose-6-phosphate isomerase
  ENSP ID: ENSP00000487666
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWD

SEQ ID NO: 34859 - protein, 162 aa, Homo sapiens; identical to SEQ ID NO: 34852
  Payload ID: 6884
  Gene Symbol: GPI
  Gene Name: glucose-6-phosphate isomerase
  ENSP ID: ENSP00000487801

SEQ ID NO: 34860 - protein, 159 aa, Homo sapiens; identical to SEQ ID NO: 34853
  Payload ID: 6884
  Gene Symbol: GPI
  Gene Name: glucose-6-phosphate isomerase
  ENSP ID: ENSP00000487931

SEQ ID NO: 34861 - protein, 166 aa, Homo sapiens; identical to SEQ ID NO: 34854
  Payload ID: 6884
  Gene Symbol: GPI
  Gene Name: glucose-6-phosphate isomerase
  ENSP ID: ENSP00000488174

SEQ ID NO: 34862 - protein, 279 aa, Homo sapiens
  Payload ID: 6884
  Gene Symbol: GPI
  Gene Name: glucose-6-phosphate isomerase
  ENSP ID: ENSP00000488295
MVALCSLQHLGSSDPRALPTLPTATSGQRPAKRRRKSPAMAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWD

SEQ ID NO: 34863 - protein, 133 aa, Homo sapiens; identical to SEQ ID NO: 34857
  Payload ID: 6884
  Gene Symbol: GPI
  Gene Name: glucose-6-phosphate isomerase
  ENSP ID: ENSP00000488409

SEQ ID NO: 34864 - protein, 161 aa, Homo sapiens; identical to SEQ ID NO: 34856
  Payload ID: 6884
  Gene Symbol: GPI
  Gene Name: glucose-6-phosphate isomerase
  ENSP ID: ENSP00000488465

SEQ ID NO: 34865 - protein, 268 aa, Homo sapiens; identical to SEQ ID NO: 34858
  Payload ID: 6884
  Gene Symbol: GPI
  Gene Name: glucose-6-phosphate isomerase
  ENSP ID: ENSP00000488493

SEQ ID NO: 34866 - protein, 10 aa, Homo sapiens
  Payload ID: 6884
  Gene Symbol: GPI
  Gene Name: glucose-6-phosphate isomerase
  ENSP ID: ENSP00000488679
  MOD_RES (1)..(1): Any amino acid
XRPAKRRRKR

SEQ ID NO: 34867 - protein, 146 aa, Homo sapiens; identical to SEQ ID NO: 34851
  Payload ID: 6884
  Gene Symbol: GPI
  Gene Name: glucose-6-phosphate isomerase
  ENSP ID: ENSP00000488744

SEQ ID NO: 34868 - protein, 283 aa, Homo sapiens
  Payload ID: 6884
  Gene Symbol: GPI
  Gene Name: glucose-6-phosphate isomerase
  ENSP ID: ENSP00000488850
TSGQRPAKRRRKSPAMAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWD

SEQ ID NO: 34869 - protein, 110 aa, Homo sapiens; identical to SEQ ID NO: 34848
  Payload ID: 6884
  Gene Symbol: GPI
  Gene Name: glucose-6-phosphate isomerase
  ENSP ID: ENSP00000488871

SEQ ID NO: 34870 - protein, 429 aa, Homo sapiens
  Payload ID: 6885
  Gene Symbol:
  Gene Name: Glucose-6-phosphate translocase  [Source:UniProtKB/Swiss-Prot
  Acc:O43826]
  Uniprot ID: O43826
  ENSP ID: ENSP00000486168
MAAQGYGYYRTVIFSAMFGGYSLYYFNRKTFSFVMPSLVEEIPLDKDDLGFITSSQSAAYAISKFVSGVLSDQMSARWLFSSGLLLVGLVNIFFAWSSTVPVFAALWFLNGLAQGLGWPPCGKVLRKWFEPSQFGTWWAILSTSMNLAGGLGPILATILAQSYSWRSTLALSGALCVVVSFLCLLLIHNEPADVGLRNLDPMPSEGKKGSLKEESTLQELLLSPYLWVLSTGYLVVFGVKTCCTDWGQFFLIQEKGQSALVGSSYMSALEVGGLVGSIAAGYLSDRAMAKAGLSNYGNPRHGLLLFMMAGMTVSMYLFRVTVTSDSPKLWILVLGAVFGFSSYGPIALFGVIANESAPPNLCGTSHAIVGLMANVGGFLAGLPFSTIAKHYSWSTAFWVAEVICAASTAAFFLLRNIRTKMGRVSKKAE

SEQ ID NO: 34871 - protein, 287 aa, Homo sapiens
  Payload ID: 6886
  Gene Symbol: GFOD1
  Gene Name: glucose-fructose oxidoreductase domain containing 1
  Uniprot ID: Q9NXC2
  ENSP ID: ENSP00000368586
MTSAAHYYPKLMSIMGNVLRFLPAFVRMKQLIEEGYVGEPLVCEVQVHGGSLLGKKYNWSCDDLMGGGGLHSVGTYIIDLLTFLTGQKAVKVHGLLKTFVKQTDHIKGIRQITSDDFCTFQMVLEGGVCCTVTLNFNVPGEFKQDVTVVGSAGRLLAVGTDLYGQRNSAPEQELLVQDATPVSNSLLPEKAFSDIPSPYLRGTIKMMQAVRQAFQDQDDRRTWDGRPLTMAATFDDCLYALCVVDTIKRSSQTGEWQNIAIMTEEPELSPAYLISEAMRRSRMSLYC

SEQ ID NO: 34872 - protein, 390 aa, Homo sapiens
  Payload ID: 6886
  Gene Symbol: GFOD1
  Gene Name: glucose-fructose oxidoreductase domain containing 1
  Uniprot ID: Q9NXC2
  ENSP ID: ENSP00000368589
MLPGVGVFGTSLTARVIIPLLKDEGFAVKALWGRTQEEAEELAKEMSVPFYTSRIDEVLLHQDVDLVCINLPPPLTRQIAVKTLGIGKNVICDRTATPLDAFRMTSAAHYYPKLMSIMGNVLRFLPAFVRMKQLIEEGYVGEPLVCEVQVHGGSLLGKKYNWSCDDLMGGGGLHSVGTYIIDLLTFLTGQKAVKVHGLLKTFVKQTDHIKGIRQITSDDFCTFQMVLEGGVCCTVTLNFNVPGEFKQDVTVVGSAGRLLAVGTDLYGQRNSAPEQELLVQDATPVSNSLLPEKAFSDIPSPYLRGTIKMMQAVRQAFQDQDDRRTWDGRPLTMAATFDDCLYALCVVDTIKRSSQTGEWQNIAIMTEEPELSPAYLISEAMRRSRMSLYC

SEQ ID NO: 34873 - protein, 148 aa, Homo sapiens
  Payload ID: 6886
  Gene Symbol: GFOD1
  Gene Name: glucose-fructose oxidoreductase domain containing 1
  ENSP ID: ENSP00000473812
MLPGVGVFGTSLTARVIIPLLKDEGFAVKALWGRTQEEAEELAKEMSVPFYTSRIDEVLLHQDVDLVCINLPPPLTRQIAVKTLEPGHQRKKISRQKNTGEKKMPRGSVQLSFCSLQHPHMGHLFTPHDAALGESQGTGFKPLGMQPV

SEQ ID NO: 34874 - protein, 287 aa, Homo sapiens; identical to SEQ ID NO: 34871
  Payload ID: 6886
  Gene Symbol: GFOD1
  Gene Name: glucose-fructose oxidoreductase domain containing 1
  Uniprot ID: Q9NXC2
  ENSP ID: ENSP00000479493

SEQ ID NO: 34875 - protein, 385 aa, Homo sapiens
  Payload ID: 6887
  Gene Symbol: GFOD2
  Gene Name: glucose-fructose oxidoreductase domain containing 2
  Uniprot ID: Q3B7J2
  ENSP ID: ENSP00000268797
MKMLPGVGVFGTGSSARVLVPLLRAEGFTVEALWGKTEEEAKQLAEEMNIAFYTSRTDDILLHQDVDLVCISIPPPLTRQISVKALGIGKNVVCEKAATSVDAFRMVTASRYYPQLMSLVGNVLRFLPAFVRMKQLISEHYVGAVMICDARIYSGSLLSPSYGWICDELMGGGGLHTMGTYIVDLLTHLTGRRAEKVHGLLKTFVRQNAAIRGIRHVTSDDFCFFQMLMGGGVCSTVTLNFNMPGAFVHEVMVVGSAGRLVARGADLYGQKNSATQEELLLRDSLAVGAGLPEQGPQDVPLLYLKGMVYMVQALRQSFQGQGDRRTWDRTPVSMAASFEDGLYMQSVVDAIKRSSRSGEWEAVEVLTEEPDTNQNLCEALQRNNL

SEQ ID NO: 34876 - protein, 112 aa, Homo sapiens
  Payload ID: 6887
  Gene Symbol: GFOD2
  Gene Name: glucose-fructose oxidoreductase domain containing 2
  Uniprot ID: Q3B7J2
  ENSP ID: ENSP00000473641
MKMLPGVGVFGTGSSARVLVPLLRAEGFTVEALWGKTEEEAKQLAEEMNIAFYTSRTDDILLHQDVDLVCISIPPPLTRQISVKALGTPGRPQQGQIMSLPLGSPLRVTPLL

SEQ ID NO: 34877 - protein, 90 aa, Homo sapiens
  Payload ID: 6887
  Gene Symbol: GFOD2
  Gene Name: glucose-fructose oxidoreductase domain containing 2
  ENSP ID: ENSP00000477581
MKMLPGVGVFGTGSSARVLVPLLRAEGFTVEALWGKTEEEAKQLAEEMNIAFYTSRTDDILLHQDVDLVCISIPPPLTRQISVKALESSL

SEQ ID NO: 34878 - protein, 88 aa, Homo sapiens
  Payload ID: 6887
  Gene Symbol: GFOD2
  Gene Name: glucose-fructose oxidoreductase domain containing 2
  ENSP ID: ENSP00000477784
MKMLPGVGVFGTGSSARVLVPLLRAEGFTVEALWGKTEEEAKQLAEEMNIAFYTSRTDDILLHQDVDLVLGRMWFARRQQHRWMPSGW

SEQ ID NO: 34879 - protein, 112 aa, Homo sapiens; identical to SEQ ID NO: 34876
  Payload ID: 6887
  Gene Symbol: GFOD2
  Gene Name: glucose-fructose oxidoreductase domain containing 2
  Uniprot ID: Q3B7J2
  ENSP ID: ENSP00000478260

SEQ ID NO: 34880 - protein, 103 aa, Homo sapiens
  Payload ID: 6887
  Gene Symbol: GFOD2
  Gene Name: glucose-fructose oxidoreductase domain containing 2
  ENSP ID: ENSP00000483913
  MOD_RES (1)..(1): Any amino acid
XKTEEEAKQLAEEMNIAFYTSRTDDILLHQDVDLVCISIPPPLTRQISVKALGSTCGVPEWSLDGCGGEAQVHTLPRWASTRRVLGRMWFARRQQHRWMPSGW

SEQ ID NO: 34881 - protein, 952 aa, Homo sapiens
  Payload ID: 6888
  Gene Symbol: GAA
  Gene Name: glucosidase, alpha
  acid
  Uniprot ID: P10253
  ENSP ID: ENSP00000305692
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPHVHSRAPSPLYSVEFSEEPFGVIVRRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPVEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 34882 - protein, 952 aa, Homo sapiens; identical to SEQ ID NO: 34881
  Payload ID: 6888
  Gene Symbol: GAA
  Gene Name: glucosidase, alpha
  acid
  Uniprot ID: P10253
  ENSP ID: ENSP00000374665

SEQ ID NO: 34883 - protein, 208 aa, Homo sapiens
  Payload ID: 6888
  Gene Symbol: GAA
  Gene Name: glucosidase, alpha
  acid
  ENSP ID: ENSP00000458306
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPHVHSRAPSPL

SEQ ID NO: 34884 - protein, 93 aa, Homo sapiens
  Payload ID: 6888
  Gene Symbol: GAA
  Gene Name: glucosidase, alpha
  acid
  ENSP ID: ENSP00000459972
  MOD_RES (1)..(1): Any amino acid
XENPPYVPGVVGGTLQAATICASSHQFLSTHYNLHNLYGLTEAIASHRALVKARGTRPFVISRSTFAGHGRYAGHWTGDVWSSWEQLASSVPA

SEQ ID NO: 34885 - protein, 284 aa, Homo sapiens
  Payload ID: 6888
  Gene Symbol: GAA
  Gene Name: glucosidase, alpha
  acid
  ENSP ID: ENSP00000460543
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPHVHSRAPSPLYSVEFSEEPFGVIVRRQLDGRVLLNTTVAPLFFADQFLQLSTSLPSQYITGLAEHLSPLMLSTSWTRITLWNRDLA

SEQ ID NO: 34886 - protein, 966 aa, Homo sapiens
  Payload ID: 6889
  Gene Symbol: GANAB
  Gene Name: glucosidase, alpha
  neutral AB
  Uniprot ID: Q14697
  ENSP ID: ENSP00000340466
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 34887 - protein, 944 aa, Homo sapiens
  Payload ID: 6889
  Gene Symbol: GANAB
  Gene Name: glucosidase, alpha
  neutral AB
  Uniprot ID: Q14697
  ENSP ID: ENSP00000349053
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 34888 - protein, 52 aa, Homo sapiens
  Payload ID: 6889
  Gene Symbol: GANAB
  Gene Name: glucosidase, alpha
  neutral AB
  Uniprot ID: Q14697
  ENSP ID: ENSP00000432181
MAAVAAVAARRRRSWASLVLAFLGVCLGITLAVDRSNFKTCEESSFCKCCWC

SEQ ID NO: 34889 - protein, 76 aa, Homo sapiens
  Payload ID: 6889
  Gene Symbol: GANAB
  Gene Name: glucosidase, alpha
  neutral AB
  ENSP ID: ENSP00000432593
MAAVAAVAARRRRSWASLVLAFLGVCLGITLAVDRSNFKTCEESSFCDREAYGQASLHTEPCWTLYSLVLIPSRSI

SEQ ID NO: 34890 - protein, 52 aa, Homo sapiens; identical to SEQ ID NO: 34888
  Payload ID: 6889
  Gene Symbol: GANAB
  Gene Name: glucosidase, alpha
  neutral AB
  Uniprot ID: Q14697
  ENSP ID: ENSP00000433799

SEQ ID NO: 34891 - protein, 119 aa, Homo sapiens
  Payload ID: 6889
  Gene Symbol: GANAB
  Gene Name: glucosidase, alpha
  neutral AB
  ENSP ID: ENSP00000434805
MAAVAAVAARRRRLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKA

SEQ ID NO: 34892 - protein, 52 aa, Homo sapiens; identical to SEQ ID NO: 34888
  Payload ID: 6889
  Gene Symbol: GANAB
  Gene Name: glucosidase, alpha
  neutral AB
  Uniprot ID: Q14697
  ENSP ID: ENSP00000434921

SEQ ID NO: 34893 - protein, 852 aa, Homo sapiens
  Payload ID: 6889
  Gene Symbol: GANAB
  Gene Name: glucosidase, alpha
  neutral AB
  ENSP ID: ENSP00000435306
MAAVAAVAARRRRLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 34894 - protein, 847 aa, Homo sapiens
  Payload ID: 6889
  Gene Symbol: GANAB
  Gene Name: glucosidase, alpha
  neutral AB
  ENSP ID: ENSP00000442962
MTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 34895 - protein, 914 aa, Homo sapiens
  Payload ID: 6890
  Gene Symbol: GANC
  Gene Name: glucosidase, alpha
  neutral C
  Uniprot ID: Q8TET4
  ENSP ID: ENSP00000326227
MEAAVKEEISLEDEAVDKNIFRDCNKIAFYRRQKQWLSKKSTYQALLDSVTTDEDSTRFQIINEASKVPLLAEIYGIEGNIFRLKINEETPLKPRFEVPDVLTSKPSTVRLISCSGDTGSLILADGKGDLKCHITANPFKVDLVSEEEVVISINSLGQLYFEHLQILHKQRAAKENEEETSVDTSQENQEDLGLWEEKFGKFVDIKANGPSSIGLDFSLHGFEHLYGIPQHAESHQLKNTGDGDAYRLYNLDVYGYQIYDKMGIYGSVPYLLAHKLGRTIGIFWLNASETLVEINTEPAVEYTLTQMGPVAAKQKVRSRTHVHWMSESGIIDVFLLTGPTPSDVFKQYSHLTGTQAMPPLFSLGYHQCRWNYEDEQDVKAVDAGFDEHDIPYDAMWLDIEHTEGKRYFTWDKNRFPNPKRMQELLRSKKRKLVVISDPHIKIDPDYSVYVKAKDQGFFVKNQEGEDFEGVCWPGLSSYLDFTNPKVREWYSSLFAFPVYQGSTDILFLWNDMNEPSVFRGPEQTMQKNAIHHGNWEHRELHNIYGFYHQMATAEGLIKRSKGKERPFVLTRSFFAGSQKYGAVWTGDNTAEWSNLKISIPMLLTLSITGISFCGADIGGFIGNPETELLVRWYQAGAYQPFFRGHATMNTKRREPWLFGEEHTRLIREAIRERYGLLPYWYSLFYHAHVASQPVMRPLWVEFPDELKTFDMEDEYMLGSALLVHPVTEPKATTVDVFLPGSNEVWYDYKTFAHWEGGCTVKIPVALDTIPVFQRGGSVIPIKTTVGKSTGWMTESSYGLRVALSTKGSSVGELYLDDGHSFQYLHQKQFLHRKFSFCSSVLINSFADQRGHYPSKCVVEKILVLGFRKEPSSVTTHSSDGKDQPVAFTYCAKTSILSLEKLSLNIATDWEVRII

SEQ ID NO: 34896 - protein, 282 aa, Homo sapiens
  Payload ID: 6890
  Gene Symbol: GANC
  Gene Name: glucosidase, alpha
  neutral C
  ENSP ID: ENSP00000399557
MEAAVKEEISLEDEAVDKNIFRDCNKIAFYRRQKQWLSKKSTYQALLDSVTTDEDSTRFQIINEASKVRCQDQSPTTLDAFKGKETTVQEETQDLSTRQHLAQKEAEEPDKQGQITWDISNVAPKTENFEDLLEQTPCSACLQGFTRDNTSSSFSEDAGISLSTSVKLPLASSSKPNENEALPNQPPSQQIRHNYRLLASTVSAEMARNRQLIWELARQSEAHLDRPVVLGEQASAQREVASILCRKSVLAINQLAATVEGTISVLQQFNELLDHPLDPGRS

SEQ ID NO: 34897 - protein, 140 aa, Homo sapiens
  Payload ID: 6890
  Gene Symbol: GANC
  Gene Name: glucosidase, alpha
  neutral C
  ENSP ID: ENSP00000454449
MEAAVKEEISLEDEAVDKNIFRDCNKIAFYRRQKQWLSKKSTYQALLDSVTTDEDSTRFQIINEASKVPLLAEIYGIEGNIFRLKINEETPLKPRFEVPDVLTSKPSTVRLISCSGDTGSLILADGKGDLKCHITANPFK

SEQ ID NO: 34898 - protein, 67 aa, Homo sapiens
  Payload ID: 6890
  Gene Symbol: GANC
  Gene Name: glucosidase, alpha
  neutral C
  ENSP ID: ENSP00000454578
MEAAVKEEISLEDEAVDKNIFRDCNKIAFYRRQKQWLSKKSTYQALLDSVTTDEDSTRFQIINEASK

SEQ ID NO: 34899 - protein, 357 aa, Homo sapiens
  Payload ID: 6890
  Gene Symbol: GANC
  Gene Name: glucosidase, alpha
  neutral C
  ENSP ID: ENSP00000454747
MEAAVKEEISLEDEAVDKNIFRDCNKIAFYRRQKQWLSKKSTYQALLDSVTTDEDSTRFQIINEASKVPLLAEIYGIEGNIFRLKINEETPLKPRFEVPDVLTSKPSTVRLISCSGDTGSLILADGKGDLKCHITANPFKVDLVSEEEVVISINSLGQLYFEHLQILHKQRAAKENEEETSVDTSQENQEDLGLWEEKFGKFVDIKANGPSSIGLDFSLHGFEHLYGIPQHAESHQLKNTGDGDAYRLYNLDVYGYQIYDKMGIYGSVPYLLAHKLGRTIGIFWLNASETLVEINTEPAVEYTLTQMGPVAAKQKVRSRTHVHWMSESGIIDVFLLTGPTPSDVFKQYSHLTDIGEK

SEQ ID NO: 34900 - protein, 9 aa, Homo sapiens
  Payload ID: 6890
  Gene Symbol: GANC
  Gene Name: glucosidase, alpha
  neutral C
  ENSP ID: ENSP00000454816
MEAAVKEEI

SEQ ID NO: 34901 - protein, 103 aa, Homo sapiens
  Payload ID: 6890
  Gene Symbol: GANC
  Gene Name: glucosidase, alpha
  neutral C
  ENSP ID: ENSP00000455511
MTESSYGLRVALSTKGSSVGELYLDDGHSFQYLHQKQFLHRKFSFCSSVLINSFADQRGHYPSKCVVEKILVLGFRKEPSSVTTHSSDGKDQPVAFTYCAKTS

SEQ ID NO: 34902 - protein, 37 aa, Homo sapiens
  Payload ID: 6890
  Gene Symbol: GANC
  Gene Name: glucosidase, alpha
  neutral C
  ENSP ID: ENSP00000455872
MEAAVKEEISLEDEAVDKNIFRDCNKIAFYRKKSVLC

SEQ ID NO: 34903 - protein, 37 aa, Homo sapiens; identical to SEQ ID NO: 34902
  Payload ID: 6890
  Gene Symbol: GANC
  Gene Name: glucosidase, alpha
  neutral C
  ENSP ID: ENSP00000456360

SEQ ID NO: 34904 - protein, 113 aa, Homo sapiens
  Payload ID: 6890
  Gene Symbol: GANC
  Gene Name: glucosidase, alpha
  neutral C
  ENSP ID: ENSP00000457604
MTESSYGLRVALSTKGSSVGELYLDDGHSFQYLHQKQFLHRKFSFCSSVLINSFADQRGHYPSKCVVEKILVLGFRKEPSSVTTHSSDGKDQPVAFTYCAKTSILSLEKLSLN

SEQ ID NO: 34905 - protein, 172 aa, Homo sapiens
  Payload ID: 6891
  Gene Symbol: GBA2
  Gene Name: glucosidase, beta (bile acid) 2
  ENSP ID: ENSP00000367328
MRDCCGMVSSGSLSSLKAAERTPGALFFSSSTPGRYYNYDSSSRPQSRSVMSDQCAGQWFLKACGLGEGDTEVFPTQHVVRALQTIFELNVQAFAGGAMGAVNGMQPHGVPDKSSVQSDEVWVGVVYGLAATMIQEVMHSFSHLSTICILAQKTSSTTKFLQGITQCHLVRL

SEQ ID NO: 34906 - protein, 877 aa, Homo sapiens
  Payload ID: 6891
  Gene Symbol: GBA2
  Gene Name: glucosidase, beta (bile acid) 2
  Uniprot ID: Q9HCG7
  ENSP ID: ENSP00000367334
MGTQDPGNMGTGVPASEQISCAKEDPQVYCPEETGGTKDVQVTDCKSPEDSRPPKETDCCNPEDSGQLMVSYEGKAMGYQVPPFGWRICLAHEFTEKRKPFQANNVSLSNMIKHIGMGLRYLQWWYRKTHVEKKTPFIDMINSVPLRQIYGCPLGGIGGGTITRGWRGQFCRWQLNPGMYQHRTVIADQFTVCLRREGQTVYQQVLSLERPSVLRSWNWGLCGYFAFYHALYPRAWTVYQLPGQNVTLTCRQITPILPHDYQDSSLPVGVFVWDVENEGDEALDVSIMFSMRNGLGGGDDAPGGLWNEPFCLERSGETVRGLLLHHPTLPNPYTMAVAARVTAATTVTHITAFDPDSTGQQVWQDLLQDGQLDSPTGQSTPTQKGVGIAGAVCVSSKLRPRGQCRLEFSLAWDMPRIMFGAKGQVHYRRYTRFFGQDGDAAPALSHYALCRYAEWEERISAWQSPVLDDRSLPAWYKSALFNELYFLADGGTVWLEVLEDSLPEELGRNMCHLRPTLRDYGRFGYLEGQEYRMYNTYDVHFYASFALIMLWPKLELSLQYDMALATLREDLTRRRYLMSGVMAPVKRRNVIPHDIGDPDDEPWLRVNAYLIHDTADWKDLNLKFVLQVYRDYYLTGDQNFLKDMWPVCLAVMESEMKFDKDHDGLIENGGYADQTYDGWVTTGPSAYCGGLWLAAVAVMVQMAALCGAQDIQDKFSSILSRGQEAYERLLWNGRYYNYDSSSRPQSRSVMSDQCAGQWFLKACGLGEGDTEVFPTQHVVRALQTIFELNVQAFAGGAMGAVNGMQPHGVPDKSSVQSDEVWVGVVYGLAATMIQELLPSGFCLWVIVISSTCWELLEGKDSTASIYPVEVALQRVPS

SEQ ID NO: 34907 - protein, 927 aa, Homo sapiens
  Payload ID: 6891
  Gene Symbol: GBA2
  Gene Name: glucosidase, beta (bile acid) 2
  Uniprot ID: Q9HCG7
  ENSP ID: ENSP00000367343
MGTQDPGNMGTGVPASEQISCAKEDPQVYCPEETGGTKDVQVTDCKSPEDSRPPKETDCCNPEDSGQLMVSYEGKAMGYQVPPFGWRICLAHEFTEKRKPFQANNVSLSNMIKHIGMGLRYLQWWYRKTHVEKKTPFIDMINSVPLRQIYGCPLGGIGGGTITRGWRGQFCRWQLNPGMYQHRTVIADQFTVCLRREGQTVYQQVLSLERPSVLRSWNWGLCGYFAFYHALYPRAWTVYQLPGQNVTLTCRQITPILPHDYQDSSLPVGVFVWDVENEGDEALDVSIMFSMRNGLGGGDDAPGGLWNEPFCLERSGETVRGLLLHHPTLPNPYTMAVAARVTAATTVTHITAFDPDSTGQQVWQDLLQDGQLDSPTGQSTPTQKGVGIAGAVCVSSKLRPRGQCRLEFSLAWDMPRIMFGAKGQVHYRRYTRFFGQDGDAAPALSHYALCRYAEWEERISAWQSPVLDDRSLPAWYKSALFNELYFLADGGTVWLEVLEDSLPEELGRNMCHLRPTLRDYGRFGYLEGQEYRMYNTYDVHFYASFALIMLWPKLELSLQYDMALATLREDLTRRRYLMSGVMAPVKRRNVIPHDIGDPDDEPWLRVNAYLIHDTADWKDLNLKFVLQVYRDYYLTGDQNFLKDMWPVCLAVMESEMKFDKDHDGLIENGGYADQTYDGWVTTGPSAYCGGLWLAAVAVMVQMAALCGAQDIQDKFSSILSRGQEAYERLLWNGRYYNYDSSSRPQSRSVMSDQCAGQWFLKACGLGEGDTEVFPTQHVVRALQTIFELNVQAFAGGAMGAVNGMQPHGVPDKSSVQSDEVWVGVVYGLAATMIQEGLTWEGFQTAEGCYRTVWERLGLAFQTPEAYCQQRVFRSLAYMRPLSIWAMQLALQQQQHKKASWPKVKQGTGLRTGPMFGPKEAMANLSPE

SEQ ID NO: 34908 - protein, 536 aa, Homo sapiens
  Payload ID: 6892
  Gene Symbol: GBA
  Gene Name: glucosidase, beta, acid
  Uniprot ID: P04062
  ENSP ID: ENSP00000314508
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 34909 - protein, 536 aa, Homo sapiens; identical to SEQ ID NO: 34908
  Payload ID: 6892
  Gene Symbol: GBA
  Gene Name: glucosidase, beta, acid
  Uniprot ID: P04062
  ENSP ID: ENSP00000357357

SEQ ID NO: 34910 - protein, 449 aa, Homo sapiens
  Payload ID: 6892
  Gene Symbol: GBA
  Gene Name: glucosidase, beta, acid
  Uniprot ID: P04062
  ENSP ID: ENSP00000397986
MELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 34911 - protein, 487 aa, Homo sapiens
  Payload ID: 6892
  Gene Symbol: GBA
  Gene Name: glucosidase, beta, acid
  Uniprot ID: P04062
  ENSP ID: ENSP00000402577
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 34912 - protein, 536 aa, Homo sapiens
  Payload ID: 6892
  Gene Symbol: GBA
  Gene Name: glucosidase, beta, acid
  ENSP ID: ENSP00000458274
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWCRQ

SEQ ID NO: 34913 - protein, 536 aa, Homo sapiens; identical to SEQ ID NO: 34912
  Payload ID: 6892
  Gene Symbol: GBA
  Gene Name: glucosidase, beta, acid
  ENSP ID: ENSP00000459642

SEQ ID NO: 34914 - protein, 487 aa, Homo sapiens
  Payload ID: 6892
  Gene Symbol: GBA
  Gene Name: glucosidase, beta, acid
  ENSP ID: ENSP00000482397
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWCRQ

SEQ ID NO: 34915 - protein, 449 aa, Homo sapiens
  Payload ID: 6892
  Gene Symbol: GBA
  Gene Name: glucosidase, beta, acid
  ENSP ID: ENSP00000482419
MELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWCRQ

SEQ ID NO: 34916 - protein, 161 aa, Homo sapiens
  Payload ID: 6893
  Gene Symbol: GBA3
  Gene Name: glucosidase, beta, acid 3 (gene/pseudogene)
  ENSP ID: ENSP00000422220
MAFPAGFGWAAATAAYQVEGGWDADGKGPCVWDTFTHQGGERVFKNQTGDVACGSYTLWEEDLKCIKQLGLTHYRFSLSWSRLLPDGTTGFINQKAIQLDKVNLQVYCAWSLLDNFEWNQGYSSRFGLFHVDFEDPARPRVPYTSAKEAKIIRNNGLEAHL

SEQ ID NO: 34917 - protein, 297 aa, Homo sapiens
  Payload ID: 6893
  Gene Symbol: GBA3
  Gene Name: glucosidase, beta, acid 3 (gene/pseudogene)
  ENSP ID: ENSP00000423754
MSYDLGMFPPGIPHFGTGGYQAAHNLIKAHARSWHSYDSLFRKKQKGMVSLSLFAVWLEPADPNSVSDQEAAKRAITFHLDLFAKPIFIDGDYPEVVKSQIASMSQKQGYPSSRLPEFTEEEKKMIKGTADFFAVQYYTTRLIKYQENKKGELGILQDAEIEFFPDPSWKNVDWIYVVPWGVCKLLKYIKDTYNNPVIYITENGFPQSDPAPLDDTQRWEYFRQTFQELFKAIQLDKVNLQVYCAWSLLDNFEWNQGYSSRFGLFHVDFEDPARPRVPYTSAKEAKIIRNNGLEAHL

SEQ ID NO: 34918 - protein, 468 aa, Homo sapiens
  Payload ID: 6893
  Gene Symbol: GBA3
  Gene Name: glucosidase, beta, acid 3 (gene/pseudogene)
  ENSP ID: ENSP00000427458
MAFPAGFGWAAATAAYQVEGGWDADGKGPCVWDTFTHQGGERVFKNQTGDVACGSYTLWEEDLKCIKQLGLTHYRFSLSWSRLLPDGTTGFINQKGIDYYNKIIDDLLKNGVTPIVTLYHFDLPQTLEDQGGWLSEAIIESFDKYAQFCFSTFGDRVKQWITINEANVLSVMSYDLGMFPPGIPHFGTGGYQAAHNLIKAHARSWHSYDSLFRKKQKGMVSLSLFAVWLEPADPNSVSDQEAAKRAITFHLDLFAKPIFIDGDYPEVVKSQIASMSQKQGYPSSRLPEFTEEEKKMIKGTADFFAVQYYTTRLIKYQENKKGELGILQDAEIEFFPDPSWKNVDWIYVVPWGVCKLLKYIKDTYNNPVIYITENGFPQSDPAPLDDTQRWEYFRQTFQELFKAIQLDKVNLQVYCAWSLLDNFEWNQGYSSRFGLFHVDFEDPARPRVPYTSAKEAKIIRNNGLEAHL

SEQ ID NO: 34919 - protein, 468 aa, Homo sapiens; identical to SEQ ID NO: 34918
  Payload ID: 6893
  Gene Symbol: GBA3
  Gene Name: glucosidase, beta, acid 3 (gene/pseudogene)
  ENSP ID: ENSP00000478226

SEQ ID NO: 34920 - protein, 161 aa, Homo sapiens; identical to SEQ ID NO: 34916
  Payload ID: 6893
  Gene Symbol: GBA3
  Gene Name: glucosidase, beta, acid 3 (gene/pseudogene)
  ENSP ID: ENSP00000480447

SEQ ID NO: 34921 - protein, 409 aa, Homo sapiens
  Payload ID: 6894
  Gene Symbol: GXYLT1
  Gene Name: glucoside xylosyltransferase 1
  Uniprot ID: Q4G148
  ENSP ID: ENSP00000280876
MRRYLRVVVLCVACGFCSLLYAFSQLAVSLEEGTGGGGGKPQAAVASWLAGGGRGAVRGAGVAGPAAHPGVSDRYSLKIQPVEKMHLAVVACGERLEETMTMLKSAIIFSIKPLQFHIFAEDQLHHSFKGRLDNWSFLQTFNYTLYPITFPSENAAEWKKLFKPCASQRLFLPLILKEVDSLLYVDTDILFLRPVDDIWSLLKKFNSTQIAAMAPEHEEPRIGWYNRFARHPYYGKTGVNSGVMLMNMTRMRRKYFKNDMTTVRLQWGDILMPLLKKYKLNITWGDQDLLNIVFFHNPESLFVFPCQWNYRPDHCIYGSNCQEAEEGGIFILHGNRGVYHDDKQPAFRAVYEALRNCSFEDDNIRSLLKPLELELQKTVHTYCGKIYKIFIKQLAKSVRDRYARSPKEK

SEQ ID NO: 34922 - protein, 440 aa, Homo sapiens
  Payload ID: 6894
  Gene Symbol: GXYLT1
  Gene Name: glucoside xylosyltransferase 1
  Uniprot ID: Q4G148
  ENSP ID: ENSP00000381666
MRRYLRVVVLCVACGFCSLLYAFSQLAVSLEEGTGGGGGKPQAAVASWLAGGGRGAVRGAGVAGPAAHPGVSDRCKDFSLCYWNPYWMLPSDVCGMNCFWEAAFRYSLKIQPVEKMHLAVVACGERLEETMTMLKSAIIFSIKPLQFHIFAEDQLHHSFKGRLDNWSFLQTFNYTLYPITFPSENAAEWKKLFKPCASQRLFLPLILKEVDSLLYVDTDILFLRPVDDIWSLLKKFNSTQIAAMAPEHEEPRIGWYNRFARHPYYGKTGVNSGVMLMNMTRMRRKYFKNDMTTVRLQWGDILMPLLKKYKLNITWGDQDLLNIVFFHNPESLFVFPCQWNYRPDHCIYGSNCQEAEEGGIFILHGNRGVYHDDKQPAFRAVYEALRNCSFEDDNIRSLLKPLELELQKTVHTYCGKIYKIFIKQLAKSVRDRYARSPKEK

SEQ ID NO: 34923 - protein, 443 aa, Homo sapiens
  Payload ID: 6895
  Gene Symbol: GXYLT2
  Gene Name: glucoside xylosyltransferase 2
  Uniprot ID: A0PJZ3
  ENSP ID: ENSP00000374268
MKLRSKAAALLLLALAALLLALLSLRAGRAEPPALPARPASAPQRHPAPVPARWPGPGALPGASPGVRRRRPPRPRPRAGRRGAARLEKLARRPGEPRSFQAVLPPELWIHLAVVACGNRLEETLVMLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKLLRLFNSTQLAAMAPEHEIPKIGWYSRFARHPFYGSAGVNSGVMLMNLTRIRSTQFKNSMIPTGLAWEDMLYPLYQKYKNAITWGDQDLLNIIFYFNPECLYVFPCQWNYRPDHCMYGSNCREAEHEGVSVLHGNRGVYHDDKQPTFRALYEAIRDFPFQDNLFQSMYYPLQLKFLETVHTLCGRIPQVFLKQIEKTMKRAYEKHVIIHVGPNQMH

SEQ ID NO: 34924 - protein, 102 aa, Homo sapiens
  Payload ID: 6895
  Gene Symbol: GXYLT2
  Gene Name: glucoside xylosyltransferase 2
  ENSP ID: ENSP00000417239
MLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKL

SEQ ID NO: 34925 - protein, 164 aa, Homo sapiens
  Payload ID: 6895
  Gene Symbol: GXYLT2
  Gene Name: glucoside xylosyltransferase 2
  ENSP ID: ENSP00000420426
MAPEHEIPKIGWYSRFARHPFYGSAGVNSGVMLMNLTRIRSTQFKNSMIPTGLAWEDMLYPLYQKYKNAITWGDQDLLNIIFYFNPECLYVFPCQWNYRPDHCMYGSNCREAEHEGVSVLHGNRGVYHDDKQPTFRALYEAIRDILRRGGKRKFVLSWISFFVM

SEQ ID NO: 34926 - protein, 617 aa, Homo sapiens
  Payload ID: 6896
  Gene Symbol: GLCE
  Gene Name: glucuronic acid epimerase
  Uniprot ID: O94923
  ENSP ID: ENSP00000261858
MRCLAARVNYKTLIIICALFTLVTVLLWNKCSSDKAIQFPRRSSSGFRVDGFEKRAAASESNNYMNHVAKQQSEEAFPQEQQKAPPVVGGFNSNVGSKVLGLKYEEIDCLINDEHTIKGRREGNEVFLPFTWVEKYFDVYGKVVQYDGYDRFEFSHSYSKVYAQRAPYHPDGVFMSFEGYNVEVRDRVKCISGVEGVPLSTQWGPQGYFYPIQIAQYGLSHYSKNLTEKPPHIEVYETAEDRDKNKPNDWTVPKGCFMANVADKSRFTNVKQFIAPETSEGVSLQLGNTKDFIISFDLKFLTNGSVSVVLETTEKNQLFTIHYVSNAQLIAFKERDIYYGIGPRTSWSTVTRDLVTDLRKGVGLSNTKAVKPTKIMPKKVVRLIAKGKGFLDNITISTTAHMAAFFAASDWLVRNQDEKGGWPIMVTRKLGEGFKSLEPGWYSAMAQGQAISTLVRAYLLTKDHIFLNSALRATAPYKFLSEQHGVKAVFMNKHDWYEEYPTTPSSFVLNGFMYSLIGLYDLKETAGEKLGKEARSLYERGMESLKAMLPLYDTGSGTIYDLRHFMLGIAPNLARWDYHTTHINQLQLLSTIDESPVFKEFVKRWKSYLKGSRAKHN

SEQ ID NO: 34927 - protein, 553 aa, Homo sapiens
  Payload ID: 6896
  Gene Symbol: GLCE
  Gene Name: glucuronic acid epimerase
  ENSP ID: ENSP00000454092
MNHVAKQQSEEAFPQEQQKAPPVVGGFNSNVGSKVLGLKYEEIDCLINDEHTIKGRREGNEVFLPFTWVEKYFDVYGKVVQYDGYDRFEFSHSYSKVYAQRAPYHPDGVFMSFEGYNVEVRDRVKCISGVEGVPLSTQWGPQGYFYPIQIAQYGLSHYSKNLTEKPPHIEVYETAEDRDKNKPNDWTVPKGCFMANVADKSRFTNVKQFIAPETSEGVSLQLGNTKDFIISFDLKFLTNGSVSVVLETTEKNQLFTIHYVSNAQLIAFKERDIYYGIGPRTSWSTVTRDLVTDLRKGVGLSNTKAVKPTKIMPKKVVRLIAKGKGFLDNITISTTAHMAAFFAASDWLVRNQDEKGGWPIMVTRKLGEGFKSLEPGWYSAMAQGQAISTLVRAYLLTKDHIFLNSALRATAPYKFLSEQHGVKAVFMNKHDWYEEYPTTPSSFVLNGFMYSLIGLYDLKETAGEKLGKEARSLYERGMESLKAMLPLYDTGSGTIYDLRHFMLGIAPNLARWDYHTTHINQLQLLSTIDESPVFKEFVKRWKSYLKGSRAKHN

SEQ ID NO: 34928 - protein, 651 aa, Homo sapiens
  Payload ID: 6897
  Gene Symbol: GUSB
  Gene Name: glucuronidase, beta
  Uniprot ID: P08236
  ENSP ID: ENSP00000302728
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 34929 - protein, 505 aa, Homo sapiens
  Payload ID: 6897
  Gene Symbol: GUSB
  Gene Name: glucuronidase, beta
  Uniprot ID: P08236
  ENSP ID: ENSP00000391390
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 34930 - protein, 144 aa, Homo sapiens
  Payload ID: 6897
  Gene Symbol: GUSB
  Gene Name: glucuronidase, beta
  ENSP ID: ENSP00000411262
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVVSQGLLCPEHIF

SEQ ID NO: 34931 - protein, 134 aa, Homo sapiens
  Payload ID: 6897
  Gene Symbol: GUSB
  Gene Name: glucuronidase, beta
  ENSP ID: ENSP00000411859
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVGW

SEQ ID NO: 34932 - protein, 144 aa, Homo sapiens; identical to SEQ ID NO: 34930
  Payload ID: 6897
  Gene Symbol: GUSB
  Gene Name: glucuronidase, beta
  ENSP ID: ENSP00000416793

SEQ ID NO: 34933 - protein, 224 aa, Homo sapiens
  Payload ID: 6898
  Gene Symbol: GAD1
  Gene Name: glutamate decarboxylase 1 (brain, 67kDa)
  Uniprot ID: Q99259
  ENSP ID: ENSP00000341167
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMPSDMRECWLLR

SEQ ID NO: 34934 - protein, 594 aa, Homo sapiens
  Payload ID: 6898
  Gene Symbol: GAD1
  Gene Name: glutamate decarboxylase 1 (brain, 67kDa)
  Uniprot ID: Q99259
  ENSP ID: ENSP00000350928
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMFTYEIAPVFVLMEQITLKKMREIVGWSSKDGDGIFSPGGAISNMYSIMAARYKYFPEVKTKGMAAVPKLVLFTSEQSHYSIKKAGAALGFGTDNVILIKCNERGKIIPADFEAKILEAKQKGYVPFYVNATAGTTVYGAFDPIQEIADICEKYNLWLHVDAAWGGGLLMSRKHRHKLNGIERANSVTWNPHKMMGVLLQCSAILVKEKGILQGCNQMCAGYLFQPDKQYDVSYDTGDKAIQCGRHVDIFKFWLMWKAKGTVGFENQINKCLELAEYLYAKIKNREEFEMVFNGEPEHTNVCFWYIPQSLRGVPDSPQRREKLHKVAPKIKALMMESGTTMVGYQPQGDKANFFRMVISNPAATQSDIDFLIEEIERLGQDL

SEQ ID NO: 34935 - protein, 224 aa, Homo sapiens; identical to SEQ ID NO: 34933
  Payload ID: 6898
  Gene Symbol: GAD1
  Gene Name: glutamate decarboxylase 1 (brain, 67kDa)
  Uniprot ID: Q99259
  ENSP ID: ENSP00000364421

SEQ ID NO: 34936 - protein, 121 aa, Homo sapiens
  Payload ID: 6898
  Gene Symbol: GAD1
  Gene Name: glutamate decarboxylase 1 (brain, 67kDa)
  ENSP ID: ENSP00000394255
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVV

SEQ ID NO: 34937 - protein, 37 aa, Homo sapiens
  Payload ID: 6898
  Gene Symbol: GAD1
  Gene Name: glutamate decarboxylase 1 (brain, 67kDa)
  ENSP ID: ENSP00000394948
MASSTPSSSATSSNAGADPNTTNLRPTTYDTWCGVAH

SEQ ID NO: 34938 - protein, 85 aa, Homo sapiens
  Payload ID: 6898
  Gene Symbol: GAD1
  Gene Name: glutamate decarboxylase 1 (brain, 67kDa)
  ENSP ID: ENSP00000402366
MASSTPSSSATSSNAGADPNTTNLRPTTYDTWCGVAHGCTRKLGLKICGFLQRTNSLEEKSRLVSAFKERQSSKNLLSCENSDRD

SEQ ID NO: 34939 - protein, 233 aa, Homo sapiens
  Payload ID: 6898
  Gene Symbol: GAD1
  Gene Name: glutamate decarboxylase 1 (brain, 67kDa)
  ENSP ID: ENSP00000403849
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMGRHIQHVQHHGCSLQVLPGS

SEQ ID NO: 34940 - protein, 115 aa, Homo sapiens
  Payload ID: 6898
  Gene Symbol: GAD1
  Gene Name: glutamate decarboxylase 1 (brain, 67kDa)
  ENSP ID: ENSP00000405917
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQ

SEQ ID NO: 34941 - protein, 425 aa, Homo sapiens
  Payload ID: 6898
  Gene Symbol: GAD1
  Gene Name: glutamate decarboxylase 1 (brain, 67kDa)
  Uniprot ID: Q99259
  ENSP ID: ENSP00000434696
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMFTYEIAPVFVLMEQITLKKMREIVGWSSKDGDGIFSPGGAISNMYSIMAARYKYFPEVKTKGMAAVPKLVLFTSEQSHYSIKKAGAALGFGTDNVILIKCNERGKIIPADFEAKILEAKQKGYVPFYVNATAGTTVYGAFDPIQEIADICEKYNLWLHVDGFNFSQLANRIICLATELMTNKGCVTWHPNYSVNMHHGCLGRWAAHVQEAPP

SEQ ID NO: 34942 - protein, 84 aa, Homo sapiens
  Payload ID: 6898
  Gene Symbol: GAD1
  Gene Name: glutamate decarboxylase 1 (brain, 67kDa)
  ENSP ID: ENSP00000476147
  MOD_RES (1)..(1): Any amino acid
XYDTWCGVAHGCTRKLGLKICGFLQRTNSLEEKSRLVSAFKERQSSKNLLSCENSDRDARFRRTETDFSNLFARGSPCPTPAPC

SEQ ID NO: 34943 - protein, 425 aa, Homo sapiens; identical to SEQ ID NO: 34941
  Payload ID: 6898
  Gene Symbol: GAD1
  Gene Name: glutamate decarboxylase 1 (brain, 67kDa)
  Uniprot ID: Q99259
  ENSP ID: ENSP00000486612

SEQ ID NO: 34944 - protein, 585 aa, Homo sapiens
  Payload ID: 6899
  Gene Symbol: GAD2
  Gene Name: glutamate decarboxylase 2 (pancreatic islets and brain, 65kDa)
  Uniprot ID: Q05329
  ENSP ID: ENSP00000259271
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 34945 - protein, 129 aa, Homo sapiens
  Payload ID: 6899
  Gene Symbol: GAD2
  Gene Name: glutamate decarboxylase 2 (pancreatic islets and brain, 65kDa)
  ENSP ID: ENSP00000365424
MNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGT

SEQ ID NO: 34946 - protein, 585 aa, Homo sapiens; identical to SEQ ID NO: 34944
  Payload ID: 6899
  Gene Symbol: GAD2
  Gene Name: glutamate decarboxylase 2 (pancreatic islets and brain, 65kDa)
  Uniprot ID: Q05329
  ENSP ID: ENSP00000365437

SEQ ID NO: 34947 - protein, 188 aa, Homo sapiens
  Payload ID: 6899
  Gene Symbol: GAD2
  Gene Name: glutamate decarboxylase 2 (pancreatic islets and brain, 65kDa)
  ENSP ID: ENSP00000390434
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGIVSSKIIKLFFRLQ

SEQ ID NO: 34948 - protein, 521 aa, Homo sapiens
  Payload ID: 6900
  Gene Symbol: GADL1
  Gene Name: glutamate decarboxylase-like 1
  Uniprot ID: Q6ZQY3
  ENSP ID: ENSP00000282538
MSSDSDRQCPVDGDIDQQEMIPSKKNAVLVDGVVLNGPTTDAKAGEKFVEEACRLIMEEVVLKATDVNEKVCEWRPPEQLKQLLDLEMRDSGEPPHKLLELCRDVIHYSVKTNHPRFFNQLYAGLDYYSLVARFMTEALNPSVYTYEVSPVFLLVEEAVLKKMIEFIGWKEGDGIFNPGGSVSNMYAMNLARYKYCPDIKEKGLSGSPRLILFTSAECHYSMKKAASFLGIGTENVCFVETDGRGKMIPEELEKQVWQARKEGAAPFLVCATSGTTVLGAFDPLDEIADICERHSLWLHVDASWGGSALMSRKHRKLLHGIHRADSVAWNPHKMLMAGIQCCALLVKDKSDLLKKCYSAKASYLFQQDKFYDVSYDTGDKSIQCSRRPDAFKFWMTWKALGTLGLEERVNRALALSRYLVDEIKKREGFKLLMEPEYANICFWYIPPSLREMEEGPEFWAKLNLVAPAIKERMMKKGSLMLGYQPHRGKVNFFRQVVISPQVSREDMDFLLDEIDLLGKDM

SEQ ID NO: 34949 - protein, 418 aa, Homo sapiens
  Payload ID: 6900
  Gene Symbol: GADL1
  Gene Name: glutamate decarboxylase-like 1
  Uniprot ID: Q6ZQY3
  ENSP ID: ENSP00000427059
MSSDSDRQCPVDGDIDQQEMIPSKKNAVLVDGVVLNGPTTDAKAGEKFVEEACRLIMEEVVLKATDVNEKVCEWRPPEQLKQLLDLEMRDSGEPPHKLLELCRDVIHYSVKTNHPRFFNQLYAGLDYYSLVARFMTEALNPSVYTYEVSPVFLLVEEAVLKKMIEFIGWKEGDGIFNPGGSVSNMYAMNLARYKYCPDIKEKGLSGSPRLILFTSAECHYSMKKAASFLGIGTENVCFVETDGRGKMIPEELEKQVWQARKEGAAPFLVCATSGTTVLGAFDPLDEIADICERHSLWLHVDASWGGSALMSRKHRKLLHGIHRADSVAWNPHKMLMAGIQCCALLVKDKSDLLKKCYSAKASYLFQQDKFYDVSYDTGDKSIQCSRRPDAFKFWMTWKALGTLGLEERVNRALALSRY

SEQ ID NO: 34950 - protein, 558 aa, Homo sapiens
  Payload ID: 6901
  Gene Symbol: GLUD1
  Gene Name: glutamate dehydrogenase 1
  Uniprot ID: P00367
  ENSP ID: ENSP00000277865
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 34951 - protein, 558 aa, Homo sapiens
  Payload ID: 6902
  Gene Symbol: GLUD2
  Gene Name: glutamate dehydrogenase 2
  Uniprot ID: P49448
  ENSP ID: ENSP00000327589
MYRYLAKALLPSRAGPAALGSAANHSAALLGRGRGQPAAASQPGLALAARRHYSELVADREDDPNFFKMVEGFFDRGASIVEDKLVKDLRTQESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTENELEKITRRFTMELAKKGFIGPGVDVPAPDMNTGEREMSWIADTYASTIGHYDINAHACVTGKPISQGGIHGRISATGRGVFHGIENFINEASYMSILGMTPGFRDKTFVVQGFGNVGLHSMRYLHRFGAKCIAVGESDGSIWNPDGIDPKELEDFKLQHGSILGFPKAKPYEGSILEVDCDILIPAATEKQLTKSNAPRVKAKIIAEGANGPTTPEADKIFLERNILVIPDLYLNAGGVTVSYFEWLKNLNHVSYGRLTFKYERDSNYHLLLSVQESLERKFGKHGGTIPIVPTAEFQDSISGASEKDIVHSALAYTMERSARQIMHTAMKYNLGLDLRTAAYVNAIEKVFKVYSEAGVTFT

SEQ ID NO: 34952 - protein, 1128 aa, Homo sapiens
  Payload ID: 6903
  Gene Symbol: GRIP1
  Gene Name: glutamate receptor interacting protein 1
  Uniprot ID: Q9Y3R0
  ENSP ID: ENSP00000352780
MIAVSFKCRCQILRRLTKDESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHVKIQRSDRQLTWDSWASNHSSLHTNHHYNTYHPDHCRVPALTFPKAPPPNSPPALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEEKADRRVSLRNMTLLATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 34953 - protein, 1076 aa, Homo sapiens
  Payload ID: 6903
  Gene Symbol: GRIP1
  Gene Name: glutamate receptor interacting protein 1
  Uniprot ID: Q9Y3R0
  ENSP ID: ENSP00000381098
MIAVSFKCRCQILRRLTKDESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHAALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEEKADRRVSLRNMTLLATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 34954 - protein, 149 aa, Homo sapiens
  Payload ID: 6903
  Gene Symbol: GRIP1
  Gene Name: glutamate receptor interacting protein 1
  ENSP ID: ENSP00000438500
MKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLS

SEQ ID NO: 34955 - protein, 188 aa, Homo sapiens
  Payload ID: 6903
  Gene Symbol: GRIP1
  Gene Name: glutamate receptor interacting protein 1
  ENSP ID: ENSP00000438921
MDRFLGFVKAIRRSRRRKGKKYRPEEDYHEGYEDVYYYASEHFRNESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTF

SEQ ID NO: 34956 - protein, 928 aa, Homo sapiens
  Payload ID: 6903
  Gene Symbol: GRIP1
  Gene Name: glutamate receptor interacting protein 1
  ENSP ID: ENSP00000439053
  MOD_RES (1)..(1): Any amino acid
XPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHVKIQRSDRQLTWDSWASNHSSLHTNHHYNTYHPDHCRVPALTFPKAPPPNSPPALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 34957 - protein, 210 aa, Homo sapiens
  Payload ID: 6903
  Gene Symbol: GRIP1
  Gene Name: glutamate receptor interacting protein 1
  ENSP ID: ENSP00000439124
MIAVSFKCRCQILRRLTKEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYD

SEQ ID NO: 34958 - protein, 77 aa, Homo sapiens
  Payload ID: 6903
  Gene Symbol: GRIP1
  Gene Name: glutamate receptor interacting protein 1
  ENSP ID: ENSP00000440918
  MOD_RES (1)..(1): Any amino acid
XSVATASGPLLVEVAKTPGASLGVALTTSMCCNKQVIVIDKIKSASIADSENSEERQATYLGFLGQQPQQPSHQPSL

SEQ ID NO: 34959 - protein, 121 aa, Homo sapiens
  Payload ID: 6903
  Gene Symbol: GRIP1
  Gene Name: glutamate receptor interacting protein 1
  ENSP ID: ENSP00000443006
LEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMGESCPNQRL

SEQ ID NO: 34960 - protein, 120 aa, Homo sapiens
  Payload ID: 6903
  Gene Symbol: GRIP1
  Gene Name: glutamate receptor interacting protein 1
  ENSP ID: ENSP00000443392
MKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNK

SEQ ID NO: 34961 - protein, 283 aa, Homo sapiens
  Payload ID: 6903
  Gene Symbol: GRIP1
  Gene Name: glutamate receptor interacting protein 1
  ENSP ID: ENSP00000443860
  MOD_RES (1)..(1): Any amino acid
XVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERC

SEQ ID NO: 34962 - protein, 787 aa, Homo sapiens
  Payload ID: 6903
  Gene Symbol: GRIP1
  Gene Name: glutamate receptor interacting protein 1
  ENSP ID: ENSP00000446011
MKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHVSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEATIMSGSTMSLNHEAPTPRSQLGRQASFQERSSSRP

SEQ ID NO: 34963 - protein, 876 aa, Homo sapiens
  Payload ID: 6903
  Gene Symbol: GRIP1
  Gene Name: glutamate receptor interacting protein 1
  ENSP ID: ENSP00000446024
MKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHAALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEEKADRRVSLRNMTLLATIMSGSTMSLNHEAPTPRSQLGRQASFQERSSSRPHYSQTTRSNTLPSDVGRKSVTL

SEQ ID NO: 34964 - protein, 1056 aa, Homo sapiens
  Payload ID: 6903
  Gene Symbol: GRIP1
  Gene Name: glutamate receptor interacting protein 1
  ENSP ID: ENSP00000446047
MIAVSFKCRCQILRRLTKDESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHAALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETRE

SEQ ID NO: 34965 - protein, 15 aa, Homo sapiens
  Payload ID: 6903
  Gene Symbol: GRIP1
  Gene Name: glutamate receptor interacting protein 1
  ENSP ID: ENSP00000446067
MKKEGTTLGLTVSGG

SEQ ID NO: 34966 - protein, 1043 aa, Homo sapiens
  Payload ID: 6904
  Gene Symbol: GRIP2
  Gene Name: glutamate receptor interacting protein 2
  ENSP ID: ENSP00000478352
MLCGLSRETPGEADDGPYSKGGKDAGGADVSLACRRQSIPEEFRGITVVELIKKEGSTLGLTISGGTDKDGKPRVSNLRPGGLAARSDLLNIGDYIRSVNGIHLTRLRHDEIITLLKNVGERVVLEVEYELPPPAPENNPRIISKTVDVSLYKEGNSFGFVLRGGAHEDGHKSRPLVLTYVRPGGPADREGSLKVGDRLLSVDGIPLHGASHATALATLRQCSHEALFQVEYDVATPDTVANASGPLMVEIVKTPGSALGISLTTTSLRNKSVITIDRIKPASVVDRSGALHPGDHILSIDGTSMEHCSLLEATKLLASISEKVRLEILPVPQSQRPLRPSEAVKVQRSEQLHRWDPCVPSCHSPRPGHCRMPTWATPAGQDQSRSLSSTPFSSPTLNHAFSCNNPSTLPRGSQPMSPRTTMGRRRQRRREHKSSLSLASSTVGPGGQIVHTETTEVVLCGDPLSGFGLQLQGGIFATETLSSPPLVCFIEPDSPAERCGLLQVGDRVLSINGIATEDGTMEEANQLLRDAALAHKVVLEVEFDVAESVIPSSGTFHVKLPKKRSVELGITISSASRKRGEPLIISDIKKGSVAHRTGTLEPGDKLLAIDNIRLDNCPMEDAVQILRQCEDLVKLKIRKDEDNSDELETTGAVSYTVELKRYGGPLGITISGTEEPFDPIVISGLTKRGLAERTGAIHVGDRILAINNVSLKGRPLSEAIHLLQVAGETVTLKIKKQLDRPLLPRKSGSLSETSDADEDPADALKGGLPAARFSPAVPSVDSAVESWDSSATEGGFGGPGSYTPQAAARGTTPQERRPGWLRGSPPPTEPRRTSYTPTPADESFPEEEEEDDWEPPTSPAPGPAREEGFWRMFGEALEDLESCGQSELLRELEASIMTGTVQRVALEGRPGHRPWQRGREVRASPAEMEELLLPTPLEMHKVTLHKDPMRHDFGFSVSDGLLEKGVYVHTVRPDGPAHRGGLQPFDRVLQVNHVRTRDFDCCLAVPLLAEAGDVLELIISRKPHTAHSSRAPRSPGPSSPRML

SEQ ID NO: 34967 - protein, 1140 aa, Homo sapiens
  Payload ID: 6904
  Gene Symbol: GRIP2
  Gene Name: glutamate receptor interacting protein 2
  ENSP ID: ENSP00000480660
MRLSSLTEEAVDGGNGGEWGEDLLEQFTCIPSRVVEAKTAPEWPLCPGEGQGLHGEPLPDHCQGTGGQIDPSLGRGGRAKQRGSRGSWWAAGETIANMLCGLSRETPGEADDGPYSKGGKDAGGADVSLACRRQSIPEEFRGITVVELIKKEGSTLGLTISGGTDKDGKPRVSNLRPGGLAARSDLLNIGDYIRSVNGIHLTRLRHDEIITLLKNVGERVVLEVEYELPPPAPENNPRIISKTVDVSLYKEGNSFGFVLRGGAHEDGHKSRPLVLTYVRPGGPADREGSLKVGDRLLSVDGIPLHGASHATALATLRQCSHEALFQVEYDVATPDTVANASGPLMVEIVKTPGSALGISLTTTSLRNKSVITIDRIKPASVVDRSGALHPGDHILSIDGTSMEHCSLLEATKLLASISEKVRLEILPVPQSQRPLRPSEAVKVQRSEQLHRWDPCVPSCHSPRPGHCRMPTWATPAGQDQSRSLSSTPFSSPTLNHAFSCNNPSTLPRGSQPMSPRTTMGRRRQRRREHKSSLSLASSTVGPGGQIVHTETTEVVLCGDPLSGFGLQLQGGIFATETLSSPPLVCFIEPDSPAERCGLLQVGDRVLSINGIATEDGTMEEANQLLRDAALAHKVVLEVEFDVAESVIPSSGTFHVKLPKKRSVELGITISSASRKRGEPLIISDIKKGSVAHRTGTLEPGDKLLAIDNIRLDNCPMEDAVQILRQCEDLVKLKIRKDEDNSDELETTGAVSYTVELKRYGGPLGITISGTEEPFDPIVISGLTKRGLAERTGAIHVGDRILAINNVSLKGRPLSEAIHLLQVAGETVTLKIKKQLDRPLLPRKSGSLSETSDADEDPADALKGGLPAARFSPAVPSVDSAVESWDSSATEGGFGGPGSYTPQAAARGTTPQERRPGWLRGSPPPTEPRRTSYTPTPADESFPEEEEEDDWEPPTSPAPGPAREEGFWRMFGEALEDLESCGQSELLRELEASIMTGTVQRVALEGRPGHRPWQRGREVRASPAEMEELLLPTPLEMHKVTLHKDPMRHDFGFSVSDGLLEKGVYVHTVRPDGPAHRGGLQPFDRVLQVNHVRTRDFDCCLAVPLLAEAGDVLELIISRKPHTAHSSRAPRSPGPSSPRML

SEQ ID NO: 34968 - protein, 327 aa, Homo sapiens
  Payload ID: 6904
  Gene Symbol: GRIP2
  Gene Name: glutamate receptor interacting protein 2
  ENSP ID: ENSP00000481670
ESVIPSSGTFHVKLPKKRSVELGITISSASRKRGEPLIISDIKKGSVAHRTGTLEPGDKLLAIDNIRLDNCPMEDAVQILRQCEDLVKLKIRKDEDNSDELETTGAVSYTVELKRYGGPLGITISGTEEPFDPIVISGLTKRGLAERTGAIHVGDRILAINNVSLKGRPLSEAIHLLQVAGETVTLKIKKQLDRPLLPRKSGSLSETSDADEDPADALKGGLPAARFSPAVPSVDSAVESWDSSATEGGFGGPGSYTPQAAARGTTPQERRPGWLRGSPPPTEPRRTSYTPTPADESFPEEEEEDDWEPPTRHPVSPLSTPSHLPLF

SEQ ID NO: 34969 - protein, 906 aa, Homo sapiens
  Payload ID: 6905
  Gene Symbol: GRIA1
  Gene Name: glutamate receptor, ionotropic, AMPA 1
  Uniprot ID: P42261
  ENSP ID: ENSP00000285900
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 34970 - protein, 906 aa, Homo sapiens
  Payload ID: 6905
  Gene Symbol: GRIA1
  Gene Name: glutamate receptor, ionotropic, AMPA 1
  Uniprot ID: P42261
  ENSP ID: ENSP00000339343
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRGPVNLAVLKLSEQGVLDKLKSKWWYDKGECGSKDSGSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 34971 - protein, 916 aa, Homo sapiens
  Payload ID: 6905
  Gene Symbol: GRIA1
  Gene Name: glutamate receptor, ionotropic, AMPA 1
  Uniprot ID: P42261
  ENSP ID: ENSP00000415569
MCCSTHLFQPLQLAGGLEWPWSNLLCFLTPVKLHPEVWGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRGPVNLAVLKLSEQGVLDKLKSKWWYDKGECGSKDSGSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 34972 - protein, 837 aa, Homo sapiens
  Payload ID: 6905
  Gene Symbol: GRIA1
  Gene Name: glutamate receptor, ionotropic, AMPA 1
  Uniprot ID: P42261
  ENSP ID: ENSP00000427864
MTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 34973 - protein, 826 aa, Homo sapiens
  Payload ID: 6905
  Gene Symbol: GRIA1
  Gene Name: glutamate receptor, ionotropic, AMPA 1
  Uniprot ID: P42261
  ENSP ID: ENSP00000427920
MQHIFAFFCTGFLGAVVGANFPNNIQIGGLFPNQQSQEHAAFRFALSQLTEPPKLLPQIDIVNISDSFEMTYRCLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 34974 - protein, 916 aa, Homo sapiens
  Payload ID: 6905
  Gene Symbol: GRIA1
  Gene Name: glutamate receptor, ionotropic, AMPA 1
  Uniprot ID: P42261
  ENSP ID: ENSP00000428994
MCCSTHLFQPLQLAGGLEWPWSNLLCFLTPVKLHPEVWGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 34975 - protein, 883 aa, Homo sapiens
  Payload ID: 6906
  Gene Symbol: GRIA2
  Gene Name: glutamate receptor, ionotropic, AMPA 2
  Uniprot ID: P42262
  ENSP ID: ENSP00000264426
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKEKTSALSLSNVAGVFYILVGGLGLAMLVALIEFCYKSRAEAKRMKVAKNAQNINPSSSQNSQNFATYKEGYNVYGIESVKI

SEQ ID NO: 34976 - protein, 883 aa, Homo sapiens
  Payload ID: 6906
  Gene Symbol: GRIA2
  Gene Name: glutamate receptor, ionotropic, AMPA 2
  Uniprot ID: P42262
  ENSP ID: ENSP00000296526
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 34977 - protein, 730 aa, Homo sapiens
  Payload ID: 6906
  Gene Symbol: GRIA2
  Gene Name: glutamate receptor, ionotropic, AMPA 2
  ENSP ID: ENSP00000318144
MVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLSGVTFKTLLFVCCG

SEQ ID NO: 34978 - protein, 836 aa, Homo sapiens
  Payload ID: 6906
  Gene Symbol: GRIA2
  Gene Name: glutamate receptor, ionotropic, AMPA 2
  Uniprot ID: P42262
  ENSP ID: ENSP00000377403
MVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 34979 - protein, 145 aa, Homo sapiens
  Payload ID: 6906
  Gene Symbol: GRIA2
  Gene Name: glutamate receptor, ionotropic, AMPA 2
  ENSP ID: ENSP00000422038
MVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMY

SEQ ID NO: 34980 - protein, 214 aa, Homo sapiens
  Payload ID: 6906
  Gene Symbol: GRIA2
  Gene Name: glutamate receptor, ionotropic, AMPA 2
  ENSP ID: ENSP00000423229
  MOD_RES (1)..(1): Any amino acid
XLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 34981 - protein, 48 aa, Homo sapiens
  Payload ID: 6906
  Gene Symbol: GRIA2
  Gene Name: glutamate receptor, ionotropic, AMPA 2
  ENSP ID: ENSP00000423988
MQKIMHISVLLSPVLWGLIFGVSSNSIQIGGLFPRGADQEYSAFRVGM

SEQ ID NO: 34982 - protein, 124 aa, Homo sapiens
  Payload ID: 6906
  Gene Symbol: GRIA2
  Gene Name: glutamate receptor, ionotropic, AMPA 2
  ENSP ID: ENSP00000425217
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPF

SEQ ID NO: 34983 - protein, 57 aa, Homo sapiens
  Payload ID: 6906
  Gene Symbol: GRIA2
  Gene Name: glutamate receptor, ionotropic, AMPA 2
  ENSP ID: ENSP00000426513
MVQFSTSEFRLTPHIDNLEVANSFAVTNAFCSQFSRGVYAIFGFYDKKSVNTITSFC

SEQ ID NO: 34984 - protein, 104 aa, Homo sapiens
  Payload ID: 6906
  Gene Symbol: GRIA2
  Gene Name: glutamate receptor, ionotropic, AMPA 2
  ENSP ID: ENSP00000426784
MRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVK

SEQ ID NO: 34985 - protein, 836 aa, Homo sapiens; identical to SEQ ID NO: 34978
  Payload ID: 6906
  Gene Symbol: GRIA2
  Gene Name: glutamate receptor, ionotropic, AMPA 2
  Uniprot ID: P42262
  ENSP ID: ENSP00000426845

SEQ ID NO: 34986 - protein, 894 aa, Homo sapiens
  Payload ID: 6907
  Gene Symbol: GRIA3
  Gene Name: glutamate receptor, ionotropic, AMPA 3
  Uniprot ID: P42263
  ENSP ID: ENSP00000446440
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 34987 - protein, 894 aa, Homo sapiens
  Payload ID: 6907
  Gene Symbol: GRIA3
  Gene Name: glutamate receptor, ionotropic, AMPA 3
  Uniprot ID: P42263
  ENSP ID: ENSP00000478489
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRTPVNLAVLKLSEQGILDKLKNKWWYDKGECGAKDSGSKDKTSALSLSNVAGVFYILVGGLGLAMMVALIEFCYKSRAESKRMKLTKNTQNFKPAPATNTQNYATYREGYNVYGTESVKI

SEQ ID NO: 34988 - protein, 144 aa, Homo sapiens
  Payload ID: 6907
  Gene Symbol: GRIA3
  Gene Name: glutamate receptor, ionotropic, AMPA 3
  ENSP ID: ENSP00000478758
MARQKKMGQSVLRAVFFLVLGLLGHSHGGFPNTISIGGLFMRNTVQEHSAFRFAVQLYNTNQNTTEKPFHLNYHVDHLDSSNSFSVTNACPAERDYLPWPGSIRENNWTALPCCKDHGLLHLKCSPGGARQNWAYCIWGVTGEL

SEQ ID NO: 34989 - protein, 144 aa, Homo sapiens; identical to SEQ ID NO: 34988
  Payload ID: 6907
  Gene Symbol: GRIA3
  Gene Name: glutamate receptor, ionotropic, AMPA 3
  ENSP ID: ENSP00000479607

SEQ ID NO: 34990 - protein, 894 aa, Homo sapiens; identical to SEQ ID NO: 34986
  Payload ID: 6907
  Gene Symbol: GRIA3
  Gene Name: glutamate receptor, ionotropic, AMPA 3
  Uniprot ID: P42263
  ENSP ID: ENSP00000481554

SEQ ID NO: 34991 - protein, 824 aa, Homo sapiens
  Payload ID: 6907
  Gene Symbol: GRIA3
  Gene Name: glutamate receptor, ionotropic, AMPA 3
  ENSP ID: ENSP00000481875
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKNACKPCSIETQ

SEQ ID NO: 34992 - protein, 902 aa, Homo sapiens
  Payload ID: 6908
  Gene Symbol: GRIA4
  Gene Name: glutamate receptor, ionotropic, AMPA 4
  Uniprot ID: P48058
  ENSP ID: ENSP00000282499
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLRTPVNLAVLKLSEAGVLDKLKNKWWYDKGECGPKDSGSKDKTSALSLSNVAGVFYILVGGLGLAMLVALIEFCYKSRAEAKRMKLTFSEAIRNKARLSITGSVGENGRVLTPDCPKAVHTGTAIRQSSGLAVIASDLP

SEQ ID NO: 34993 - protein, 433 aa, Homo sapiens
  Payload ID: 6908
  Gene Symbol: GRIA4
  Gene Name: glutamate receptor, ionotropic, AMPA 4
  Uniprot ID: P48058
  ENSP ID: ENSP00000376833
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMPLMKNPILRN

SEQ ID NO: 34994 - protein, 884 aa, Homo sapiens
  Payload ID: 6908
  Gene Symbol: GRIA4
  Gene Name: glutamate receptor, ionotropic, AMPA 4
  ENSP ID: ENSP00000376835
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLRNAVNLAVLKLNEQGLLDKLKNKWWYDKGECGSGGGDSKDKTSALSLSNVAGVFYILVGGLGLAMLVALIEFCYKSRAEAKRMKVAKSAQTFNPTSSQNTQNLATYREGYNVYGTESIKI

SEQ ID NO: 34995 - protein, 433 aa, Homo sapiens; identical to SEQ ID NO: 34993
  Payload ID: 6908
  Gene Symbol: GRIA4
  Gene Name: glutamate receptor, ionotropic, AMPA 4
  Uniprot ID: P48058
  ENSP ID: ENSP00000415551

SEQ ID NO: 34996 - protein, 884 aa, Homo sapiens; identical to SEQ ID NO: 34994
  Payload ID: 6908
  Gene Symbol: GRIA4
  Gene Name: glutamate receptor, ionotropic, AMPA 4
  ENSP ID: ENSP00000432180

SEQ ID NO: 34997 - protein, 84 aa, Homo sapiens
  Payload ID: 6908
  Gene Symbol: GRIA4
  Gene Name: glutamate receptor, ionotropic, AMPA 4
  ENSP ID: ENSP00000432371
MRIISRQIVLLFSGFWGLAMGAFPSSVQIGGLFIRNTDQEYTAFRLAIFLHNTSPNASEAPFNLVPHVDNIETANSFAVTNACK

SEQ ID NO: 34998 - protein, 225 aa, Homo sapiens
  Payload ID: 6908
  Gene Symbol: GRIA4
  Gene Name: glutamate receptor, ionotropic, AMPA 4
  ENSP ID: ENSP00000432443
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGLVISTTPLASNCMPSSVVHSWLYVLYNKSINSITACLLGPSTELNVFNYLIADSNLNNGNYI

SEQ ID NO: 34999 - protein, 82 aa, Homo sapiens
  Payload ID: 6908
  Gene Symbol: GRIA4
  Gene Name: glutamate receptor, ionotropic, AMPA 4
  ENSP ID: ENSP00000433621
MRIISRQIVLLFSGFWGLAMGAFPSSVQIGGLFIRNTDQEYTAFRLAIFLHNTSPNASEAPFNLVPHVDNIETANSFAVTNA

SEQ ID NO: 35000 - protein, 104 aa, Homo sapiens
  Payload ID: 6908
  Gene Symbol: GRIA4
  Gene Name: glutamate receptor, ionotropic, AMPA 4
  ENSP ID: ENSP00000433873
  MOD_RES (1)..(1): Any amino acid
XVARVRKSKGKFAFLLESTMNEYIEQRKPCDTMKVGGNLDSKGYGVATPKGSSLRNAVNLAVLKLNEQGLLDKLKNKWWYDKGECGSGGGDSKNSCKPCRFETQ

SEQ ID NO: 35001 - protein, 902 aa, Homo sapiens; identical to SEQ ID NO: 34992
  Payload ID: 6908
  Gene Symbol: GRIA4
  Gene Name: glutamate receptor, ionotropic, AMPA 4
  Uniprot ID: P48058
  ENSP ID: ENSP00000435775

SEQ ID NO: 35002 - protein, 82 aa, Homo sapiens; identical to SEQ ID NO: 34999
  Payload ID: 6908
  Gene Symbol: GRIA4
  Gene Name: glutamate receptor, ionotropic, AMPA 4
  ENSP ID: ENSP00000436143

SEQ ID NO: 35003 - protein, 82 aa, Homo sapiens; identical to SEQ ID NO: 34999
  Payload ID: 6908
  Gene Symbol: GRIA4
  Gene Name: glutamate receptor, ionotropic, AMPA 4
  ENSP ID: ENSP00000436449

SEQ ID NO: 35004 - protein, 1009 aa, Homo sapiens
  Payload ID: 6909
  Gene Symbol: GRID1
  Gene Name: glutamate receptor, ionotropic, delta 1
  Uniprot ID: Q9ULK0
  ENSP ID: ENSP00000330148
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 35005 - protein, 755 aa, Homo sapiens
  Payload ID: 6909
  Gene Symbol: GRID1
  Gene Name: glutamate receptor, ionotropic, delta 1
  ENSP ID: ENSP00000433064
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKDPGAAGHRGPGCAEAEVVAAHGPL

SEQ ID NO: 35006 - protein, 749 aa, Homo sapiens
  Payload ID: 6909
  Gene Symbol: GRID1
  Gene Name: glutamate receptor, ionotropic, delta 1
  ENSP ID: ENSP00000444455
EISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 35007 - protein, 1007 aa, Homo sapiens
  Payload ID: 6910
  Gene Symbol: GRID2
  Gene Name: glutamate receptor, ionotropic, delta 2
  Uniprot ID: O43424
  ENSP ID: ENSP00000282020
MEVFPFLLVLSVWWSRTWDSANADSIIHIGAIFDESAKKDDEVFRTAVGDLNQNEEILQTEKITFSVTFVDGNNPFQAVQEACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 35008 - protein, 912 aa, Homo sapiens
  Payload ID: 6910
  Gene Symbol: GRID2
  Gene Name: glutamate receptor, ionotropic, delta 2
  Uniprot ID: O43424
  ENSP ID: ENSP00000421257
MEVFPFLLVLSVWWSRTWDSANADSIIHIGAIFDESAKKDDEVFRTAVGDLNQNEEILQTEKITFSVTFVDGNNPFQAVQEDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 35009 - protein, 163 aa, Homo sapiens
  Payload ID: 6910
  Gene Symbol: GRID2
  Gene Name: glutamate receptor, ionotropic, delta 2
  ENSP ID: ENSP00000422845
MNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEMSF

SEQ ID NO: 35010 - protein, 73 aa, Homo sapiens
  Payload ID: 6910
  Gene Symbol: GRID2
  Gene Name: glutamate receptor, ionotropic, delta 2
  ENSP ID: ENSP00000423331
MEISNLYIYDTVLLLANAFHKKLEDRKWHSMASLSCIRKNSKPWQGGRSMLETIKKGGVSGLTGELEFGENGG

SEQ ID NO: 35011 - protein, 62 aa, Homo sapiens
  Payload ID: 6910
  Gene Symbol: GRID2
  Gene Name: glutamate receptor, ionotropic, delta 2
  ENSP ID: ENSP00000425794
GGVSGLTGELEFGENGGNPNVHFEILGTNYGEELGRGVRKNERIRPQGSTGKIWPQVNFIFK

SEQ ID NO: 35012 - protein, 926 aa, Homo sapiens
  Payload ID: 6910
  Gene Symbol: GRID2
  Gene Name: glutamate receptor, ionotropic, delta 2
  ENSP ID: ENSP00000483084
ACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 35013 - protein, 1211 aa, Homo sapiens
  Payload ID: 6911
  Gene Symbol: GRID2IP
  Gene Name: glutamate receptor, ionotropic, delta 2 (Grid2) interacting protein
  Uniprot ID: A4D2P6
  ENSP ID: ENSP00000397351
MATTATPATNQGWPEDFGFRLGGSGPCFVLEVAKGSSAHAGGLRPGDQILEVEGLAVGGLSRERLVRLARRCPRVPPSLGVLPAPDGGPGPGSGPAAPTTVLRAPRCGRGLALGRELLRLAGRKRPDAVHRERRRKAQEFSRKVDEILGDQPTAKEQVFAALKQFAAEQRVDDLVWTLTLALPREACGPLLDNLRIFIPKKHRARFDEVVSQGLLGKLCRARRAQGAQRLRRSRSEERPERLLVSTRASAPPRRPDEPPPRRASLLVGGLAGPGGARRTVRVYKGNKSFGFTLRGHGPVWIESVLPGSPADNAALKSGDRILFLNGLDMRNCSHDKVVSMLQGSGAMPTLVVEEGLVPFASDSDSLDSPNPSSALTSLQWVAEILPSSIRVQGRTFSQQLEHLLTPPERYGVCRALESFFQHRNIDTLIVDVYPVLDTPAKQVLWQFIYQLLTYEEQELCQEKIACFLGYTAMTAEPEPELDLESEPTPEPQPRSSLRASSMCRRSLRSQGLEAGLSCGPSECPEMPLPLIPGERQAGDGTSLPETPNPKMMSAVYAELESRLNSSFKGKMGTVSKSRASPPGPSPAVTTGPRTLSGVSWPSERLLPSPCYHPLCSGGLASPSSSESHPYASLDSSRAPSPQPGPGPICPDSPPSPDPTRPPSRRKLFTFSHPVRSRDTDRFLDVLSEQLGPRVTIVDDFLTPENDYEEMSFHDDQGSFVTNERSSASDCISSSEEGSSLTYSSISDHIPPPPLSPPPPPPLPFHDAKPSSRSSDGSRGPAQALAKPLTQLSHPVPPPPPPPLPPPVPCAPPMLSRGLGHRRSETSHMSVKRLRWEQVENSEGTIWGQLGEDSDYDKLSDMVKYLDLELHFGTQKPAKPVPGPEPFRKKEVVEILSHKKAYNTSILLAHLKLSPAELRQVLMSMEPRRLEPAHLAQLLLFAPDADEEQRYQAFREAPGRLSEPDQFVLQMLSVPEYKTRLRSLHFQATLQEKTEEIRGSLECLRQASLELKNSRKLAKILEFVLAMGNYLNDGQPKTNKTTGFKINFLTELNSTKTVDGKSTFLHILAKSLSQHFPELLGFAQDLPTVPLAAKVNQRALTSDLADLHGTISEIQDACQSISPSSEDKFAMVMSSFLETAQPALRALDGLQREAMEELGKALAFFGEDSKATTSEAFFGIFAEFMSKFERALSDLQAGEGLRSSGMVSPLAW

SEQ ID NO: 35014 - protein, 1020 aa, Homo sapiens
  Payload ID: 6911
  Gene Symbol: GRID2IP
  Gene Name: glutamate receptor, ionotropic, delta 2 (Grid2) interacting protein
  ENSP ID: ENSP00000397887
MSCLGIFIPKKHRARFDEVVSQGLLGKLCRARRAQGAQRLRRSRSEERPERLLVSTRASAPPRRPDEPPPRRASLLVGGLAGPGGARRTVRVYKGNKSFGFTLRGHGPVWIESVLPGSPADNAALKSGDRILFLNGLDMRNCSHDKVVSMLQGSGAMPTLVVEEGLVPFASDSDSLDSPNPSSALTSLQWVAEILPSSIRVQGRTFSQQLEHLLTPPERYGVCRALESFFQHRNIDTLIVDVYPVLDTPAKQVLWQFIYQLLTYEEQELCQEKIACFLGYTAMTEPEPELDLESEPTPEPQPRSSLRASSMCRRSLRSQGLEAGLSCGPSECPEMPLPLIPGERQAGDGTSLPETPNPKMMSAVYAELESRLNSSFKGKMGTVSKSRASPPGPSPAVTTGPRTLSGVSWPSERLLPSPCYHPLCSGGLASPSSSESHPYASLDSSRAPSPQPGPGPICPDSPPSPDPTRPPSRRKLFTFSHPVRSRDTDRFLDVLSEQLGPRVTIVDDFLTPENDYEEMSFHDDQGSFVTNERSSASDCISSSEEGSSLTYSSISDHIPPPPLSPPPPPPLPFHDAKPSSRSSDGSRGPAQALAKPLTQLSHPVPPPPPPPLPPPVPCAPPMLSRGLGHRRSETSHMSVKRLRWEQVENSEGTIWGQLGEDSDYDKLSDMVKYLDLELHFGTQKPAKPVPGPEPFRKKEVVEILSHKKAYNTSILLAHLKLSPAELRQVLMSMEPRRLEPAHLAQLLLFAPDADEEQRYQAFREAPGRLSEPDQFVLQMLSVPEYKTRLRSLHFQATLQEKTEEIRGSLECLRQASLELKNSRKLAKILEFVLAMGNYLNDGQPKTNKTTGFKINFLTELNSTKTVDGKSTFLHILAKSLSQHFPELLGFAQDLPTVPLAAKVNQRALTSDLADLHGTISEIQDACQSISPSSEDKFAMVMSSFLETAQPALRALDGLQREAMEELGKALAFFGEDSKATTSEAFFGIFAEFMSKFERALSDLQAGEGLRSSGMVSPLAW

SEQ ID NO: 35015 - protein, 1027 aa, Homo sapiens
  Payload ID: 6911
  Gene Symbol: GRID2IP
  Gene Name: glutamate receptor, ionotropic, delta 2 (Grid2) interacting protein
  ENSP ID: ENSP00000408364
MGKDQGFSRHFRIFIPKKHRARFDEVVSQGLLGKLCRARRAQGAQRLRRSRSEERPERLLVSTRASAPPRRPDEPPPRRASLLVGGLAGPGGARRTVRVYKGNKSFGFTLRGHGPVWIESVLPGSPADNAALKSGDRILFLNGLDMRNCSHDKVVSMLQGSGAMPTLVVEEGLVPFASDSDSLDSPNPSSALTSLQWVAEILPSSIRVQGRTFSQQLEHLLTPPERYGVCRALESFFQHRNIDTLIVDVYPVLDTPAKQVLWQFIYQLLTYEEQELCQEKIACFLGYTAMTEPEPELDLESEPTPEPQPRSSLRASSMCRRSLRSQGLEAGLSCGPSECPEMPLPLIPGERQAGDGTSLPETPNPKMMSAVYAELESRLNSSFKGKMGTVSKSRASPPGPSPAVTTGPRTLSGVSWPSERLLPSPCYHPLCSGGLASPSSSESHPYASLDSSRAPSPQPGPGPICPDSPPSPDPTRPPSRRKLFTFSHPVRSRDTDRFLDVLSEQLGPRVTIVDDFLTPENDYEEMSFHDDQGSFVTNERSSASDCISSSEEGSSLTYSSISDHIPPPPLSPPPPPPLPFHDAKPSSRSSDGSRGPAQALAKPLTQLSHPVPPPPPPPLPPPVPCAPPMLSRGLGHRRSETSHMSVKRLRWEQVENSEGTIWGQLGEDSDYDKLSDMVKYLDLELHFGTQKPAKPVPGPEPFRKKEVVEILSHKKAYNTSILLAHLKLSPAELRQVLMSMEPRRLEPAHLAQLLLFAPDADEEQRYQAFREAPGRLSEPDQFVLQMLSVPEYKTRLRSLHFQATLQEKTEEIRGSLECLRQASLELKNSRKLAKILEFVLAMGNYLNDGQPKTNKTTGFKINFLTELNSTKTVDGKSTFLHILAKSLSQHFPELLGFAQDLPTVPLAAKVNQRALTSDLADLHGTISEIQDACQSISPSSEDKFAMVMSSFLETAQPALRALDGLQREAMEELGKALAFFGEDSKATTSEAFFGIFAEFMSKFERALSDLQAGEGLRSSGMVSPLAW

SEQ ID NO: 35016 - protein, 879 aa, Homo sapiens
  Payload ID: 6912
  Gene Symbol: GRIK1
  Gene Name: glutamate receptor, ionotropic, kainate 1
  ENSP ID: ENSP00000311646
GGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 35017 - protein, 949 aa, Homo sapiens
  Payload ID: 6912
  Gene Symbol: GRIK1
  Gene Name: glutamate receptor, ionotropic, kainate 1
  ENSP ID: ENSP00000327687
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQKGKSSRIRFYFRNKVRFHGRKKQSLGVEKCLSFNAIMEELGISLKNQKKIKKKSRTKGKSSFTSILTCHQRRTQRKETVA

SEQ ID NO: 35018 - protein, 871 aa, Homo sapiens
  Payload ID: 6912
  Gene Symbol: GRIK1
  Gene Name: glutamate receptor, ionotropic, kainate 1
  ENSP ID: ENSP00000373776
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQHY

SEQ ID NO: 35019 - protein, 905 aa, Homo sapiens
  Payload ID: 6912
  Gene Symbol: GRIK1
  Gene Name: glutamate receptor, ionotropic, kainate 1
  Uniprot ID: P39086
  ENSP ID: ENSP00000373777
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 35020 - protein, 918 aa, Homo sapiens
  Payload ID: 6912
  Gene Symbol: GRIK1
  Gene Name: glutamate receptor, ionotropic, kainate 1
  Uniprot ID: P39086
  ENSP ID: ENSP00000382791
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 35021 - protein, 903 aa, Homo sapiens
  Payload ID: 6912
  Gene Symbol: GRIK1
  Gene Name: glutamate receptor, ionotropic, kainate 1
  ENSP ID: ENSP00000382793
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 35022 - protein, 920 aa, Homo sapiens
  Payload ID: 6912
  Gene Symbol: GRIK1
  Gene Name: glutamate receptor, ionotropic, kainate 1
  ENSP ID: ENSP00000382797
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 35023 - protein, 934 aa, Homo sapiens
  Payload ID: 6912
  Gene Symbol: GRIK1
  Gene Name: glutamate receptor, ionotropic, kainate 1
  ENSP ID: ENSP00000382798
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQKGKSSRIRFYFRNKVRFHGRKKQSLGVEKCLSFNAIMEELGISLKNQKKIKKKSRTKGKSSFTSILTCHQRRTQRKETVA

SEQ ID NO: 35024 - protein, 866 aa, Homo sapiens
  Payload ID: 6912
  Gene Symbol: GRIK1
  Gene Name: glutamate receptor, ionotropic, kainate 1
  ENSP ID: ENSP00000446326
GGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 35025 - protein, 854 aa, Homo sapiens
  Payload ID: 6913
  Gene Symbol: GRIK2
  Gene Name: glutamate receptor, ionotropic, kainate 2
  ENSP ID: ENSP00000313276
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRAKTKLPQDYVFLPILESVSISTVLSSSPSSSSLSSCS

SEQ ID NO: 35026 - protein, 353 aa, Homo sapiens
  Payload ID: 6913
  Gene Symbol: GRIK2
  Gene Name: glutamate receptor, ionotropic, kainate 2
  ENSP ID: ENSP00000351128
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTMEFHSCCPGWSAMARSQLTATSASWVQAILLPQPPE

SEQ ID NO: 35027 - protein, 870 aa, Homo sapiens
  Payload ID: 6913
  Gene Symbol: GRIK2
  Gene Name: glutamate receptor, ionotropic, kainate 2
  ENSP ID: ENSP00000358130
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 35028 - protein, 831 aa, Homo sapiens
  Payload ID: 6913
  Gene Symbol: GRIK2
  Gene Name: glutamate receptor, ionotropic, kainate 2
  ENSP ID: ENSP00000358133
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKESSIWLVPPYHPDTV

SEQ ID NO: 35029 - protein, 892 aa, Homo sapiens
  Payload ID: 6913
  Gene Symbol: GRIK2
  Gene Name: glutamate receptor, ionotropic, kainate 2
  Uniprot ID: Q13002
  ENSP ID: ENSP00000358134
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRAKTKLPQDYVFLPILESVSISTVLSSSPSSSSLSSCS

SEQ ID NO: 35030 - protein, 180 aa, Homo sapiens
  Payload ID: 6913
  Gene Symbol: GRIK2
  Gene Name: glutamate receptor, ionotropic, kainate 2
  ENSP ID: ENSP00000391988
CSHEMAAGILKQALAMGMMTEYYHYIFTTLTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLL

SEQ ID NO: 35031 - protein, 908 aa, Homo sapiens
  Payload ID: 6913
  Gene Symbol: GRIK2
  Gene Name: glutamate receptor, ionotropic, kainate 2
  Uniprot ID: Q13002
  ENSP ID: ENSP00000397026
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 35032 - protein, 869 aa, Homo sapiens
  Payload ID: 6913
  Gene Symbol: GRIK2
  Gene Name: glutamate receptor, ionotropic, kainate 2
  Uniprot ID: Q13002
  ENSP ID: ENSP00000405596
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKESSIWLVPPYHPDTV

SEQ ID NO: 35033 - protein, 182 aa, Homo sapiens
  Payload ID: 6913
  Gene Symbol: GRIK2
  Gene Name: glutamate receptor, ionotropic, kainate 2
  ENSP ID: ENSP00000407140
IGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIAR

SEQ ID NO: 35034 - protein, 919 aa, Homo sapiens [sequence omitted]

SEQ ID NO: 35035 - protein, 872 aa, Homo sapiens
  Payload ID: 6914
  Gene Symbol: GRIK3
  Gene Name: glutamate receptor, ionotropic, kainate 3
  Uniprot ID: Q13003
  ENSP ID: ENSP00000362185
MTAPWRRLRSLVWEYWAGLLVCAFWIPDSRGMPHVIRIGGIFEYADGPNAQVMNAEEHAFRFSANIINRNRTLLPNTTLTYDIQRIHFHDSFEATKKACDQLALGVVAIFGPSQGSCTNAVQSICNALEVPHIQLRWKHHPLDNKDTFYVNLYPDYASLSHAILDLVQYLKWRSATVVYDDSTGLIRLQELIMAPSRYNIRLKIRQLPIDSDDSRPLLKEMKRGREFRIIFDCSHTMAAQILKQAMAMGMMTEYYHFIFTTLDLYALDLEPYRYSGVNLTGFRILNVDNPHVSAIVEKWSMERLQAAPRSESGLLDGVMMTDAALLYDAVHIVSVCYQRAPQMTVNSLQCHRHKAWRFGGRFMNFIKEAQWEGLTGRIVFNKTSGLRTDFDLDIISLKEDGLEKVGVWSPADGLNITEVAKGRGPNVTDSLTNRSLIVTTVLEEPFVMFRKSDRTLYGNDRFEGYCIDLLKELAHILGFSYEIRLVEDGKYGAQDDKGQWNGMVKELIDHKADLAVAPLTITHVREKAIDFSKPFMTLGVSILYRKPNGTNPSVFSFLNPLSPDIWMYVLLAYLGVSCVLFVIARFSPYEWYDAHPCNPGSEVVENNFTLLNSFWFGMGSLMQQGSELMPKALSTRIIGGIWWFFTLIIISSYTANLAAFLTVERMESPIDSADDLAKQTKIEYGAVKDGATMTFFKKSKISTFEKMWAFMSSKPSALVKNNEEGIQRALTADYALLMESTTIEYVTQRNCNLTQIGGLIDSKGYGIGTPMGSPYRDKITIAILQLQEEDKLHIMKEKWWRGSGCPEEENKEASALGIQKIGGIFIVLAAGLVLSVLVAVGEFVYKLRKTAEREQVSLRAWSLHRMGNGDSR

SEQ ID NO: 35036 - protein, 956 aa, Homo sapiens
  Payload ID: 6915
  Gene Symbol: GRIK4
  Gene Name: glutamate receptor, ionotropic, kainate 4
  Uniprot ID: Q16099
  ENSP ID: ENSP00000404063
MPRVSAPLVLLPAWLVMVACSPHSLRIAAILDDPMECSRGERLSITLAKNRINRAPERLGKAKVEVDIFELLRDSEYETAETMCQILPKGVVAVLGPSSSPASSSIISNICGEKEVPHFKVAPEEFVKFQFQRFTTLNLHPSNTDISVAVAGILNFFNCTTACLICAKAECLLNLEKLLRQFLISKDTLSVRMLDDTRDPTPLLKEIRDDKTATIIIHANASMSHTILLKAAELGMVSAYYTYIFTNLEFSLQRMDSLVDDRVNILGFSIFNQSHAFFQEFAQSLNQSWQENCDHVPFTGPALSSALLFDAVYAVVTAVQELNRSQEIGVKPLSCGSAQIWQHGTSLMNYLRMVELEGLTGHIEFNSKGQRSNYALKILQFTRNGFRQIGQWHVAEGLSMDSHLYASNISDTLFNTTLVVTTILENPYLMLKGNHQEMEGNDRYEGFCVDMLKELAEILRFNYKIRLVGDGVYGVPEANGTWTGMVGELIARKADLAVAGLTITAEREKVIDFSKPFMTLGISILYRVHMGRKPGYFSFLDPFSPGVWLFMLLAYLAVSCVLFLVARLTPYEWYSPHPCAQGRCNLLVNQYSLGNSLWFPVGGFMQQGSTIAPRALSTRCVSGVWWAFTLIIISSYTANLAAFLTVQRMDVPIESVDDLADQTAIEYGTIHGGSSMTFFQNSRYQTYQRMWNYMYSKQPSVFVKSTEEGIARVLNSNYAFLLESTMNEYYRQRNCNLTQIGGLLDTKGYGIGMPVGSVFRDEFDLAILQLQENNRLEILKRKWWEGGKCPKEEDHRAKGLGMENIGGIFVVLICGLIVAIFMAMLEFLWTLRHSEATEVSVCQEMVTELRSIILCQDSIHPRRRRAAVPPPRPPIPEERRPRGTATLSNGKLCGAGEPDQLAQRLAQEAALVARGCTHIRVCPECRRFQGLRARPSPARSEESLEWEKTTNSSEPE

SEQ ID NO: 35037 - protein, 956 aa, Homo sapiens; identical to SEQ ID NO: 35036
  Payload ID: 6915
  Gene Symbol: GRIK4
  Gene Name: glutamate receptor, ionotropic, kainate 4
  Uniprot ID: Q16099
  ENSP ID: ENSP00000435648

SEQ ID NO: 35038 - protein, 980 aa, Homo sapiens
  Payload ID: 6916
  Gene Symbol: GRIK5
  Gene Name: glutamate receptor, ionotropic, kainate 5
  Uniprot ID: Q16478
  ENSP ID: ENSP00000262895
MPAELLLLLIVAFASPSCQVLSSLRMAAILDDQTVCGRGERLALALAREQINGIIEVPAKARVEVDIFELQRDSQYETTDTMCQILPKGVVSVLGPSSSPASASTVSHICGEKEIPHIKVGPEETPRLQYLRFASVSLYPSNEDVSLAVSRILKSFNYPSASLICAKAECLLRLEELVRGFLISKETLSVRMLDDSRDPTPLLKEIRDDKVSTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEEVSVCQEMLQELRHAVSCRKTSRSRRRRRPGGPSRALLSLRAVREMRLSNGKLYSAGAGGDAGSAHGGPQRLLDDPGPPSGARPAAPTPCTHVRVCQECRRIQALRASGAGAPPRGLGVPAEATSPPRPRPGPAGPRELAEHE

SEQ ID NO: 35039 - protein, 981 aa, Homo sapiens
  Payload ID: 6916
  Gene Symbol: GRIK5
  Gene Name: glutamate receptor, ionotropic, kainate 5
  Uniprot ID: Q16478
  ENSP ID: ENSP00000301218
MPAELLLLLIVAFASPSCQVLSSLRMAAILDDQTVCGRGERLALALAREQINGIIEVPAKARVEVDIFELQRDSQYETTDTMCQILPKGVVSVLGPSSSPASASTVSHICGEKEIPHIKVGPEETPRLQYLRFASVSLYPSNEDVSLAVSRILKSFNYPSASLICAKAECLLRLEELVRGFLISKETLSVRMLDDSRDPTPLLKEIRDDKVSTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEETPALHPAACQCSALGPRTPLKEPSMLLVKVPSTRVQVAFSRTSLRQVCPFLLQHQLSSLYWIQATNVQICCHFSSLKPSPDLTFPPSHRPLSSLLFTALAAVGGLPDASSFFFPPISSCPPLQSGIGPCHSTEATLVTSNFHV

SEQ ID NO: 35040 - protein, 110 aa, Homo sapiens
  Payload ID: 6916
  Gene Symbol: GRIK5
  Gene Name: glutamate receptor, ionotropic, kainate 5
  ENSP ID: ENSP00000469135
MPAELLLLLIVAFASPSCQVLSSLRMAAILDDQTVCGRGERLALALAREQINGIIEVPAKARVEVDIFELQRDSQYETTDTIAMARRMEFCDSPRPASGASQSWEPWTEG

SEQ ID NO: 35041 - protein, 980 aa, Homo sapiens; identical to SEQ ID NO: 35038
  Payload ID: 6916
  Gene Symbol: GRIK5
  Gene Name: glutamate receptor, ionotropic, kainate 5
  Uniprot ID: Q16478
  ENSP ID: ENSP00000470251

SEQ ID NO: 35042 - protein, 356 aa, Homo sapiens
  Payload ID: 6917
  Gene Symbol: GRIN1
  Gene Name: glutamate receptor, ionotropic, N-methyl D-aspartate 1
  ENSP ID: ENSP00000316915
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDAHQRQERVGPHQRRRGRGGPGRARAPREGEHHRPAAGLRGQHQHLEDRAALQESADVFQVCGWGDWSRGVQ

SEQ ID NO: 35043 - protein, 959 aa, Homo sapiens
  Payload ID: 6917
  Gene Symbol: GRIN1
  Gene Name: glutamate receptor, ionotropic, N-methyl D-aspartate 1
  Uniprot ID: Q05586
  ENSP ID: ENSP00000360601
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 35044 - protein, 901 aa, Homo sapiens
  Payload ID: 6917
  Gene Symbol: GRIN1
  Gene Name: glutamate receptor, ionotropic, N-methyl D-aspartate 1
  Uniprot ID: Q05586
  ENSP ID: ENSP00000360605
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQSTGGGRGALQNQKDTVLPRRAIEREEGQLQLCSRHRES

SEQ ID NO: 35045 - protein, 943 aa, Homo sapiens
  Payload ID: 6917
  Gene Symbol: GRIN1
  Gene Name: glutamate receptor, ionotropic, N-methyl D-aspartate 1
  Uniprot ID: Q05586
  ENSP ID: ENSP00000360608
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 35046 - protein, 922 aa, Homo sapiens
  Payload ID: 6917
  Gene Symbol: GRIN1
  Gene Name: glutamate receptor, ionotropic, N-methyl D-aspartate 1
  ENSP ID: ENSP00000360610
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQSTGGGRGALQNQKDTVLPRRAIEREEGQLQLCSRHRES

SEQ ID NO: 35047 - protein, 885 aa, Homo sapiens
  Payload ID: 6917
  Gene Symbol: GRIN1
  Gene Name: glutamate receptor, ionotropic, N-methyl D-aspartate 1
  Uniprot ID: Q05586
  ENSP ID: ENSP00000360614
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQQYHPTDITGPLNLSDPSVSTVV

SEQ ID NO: 35048 - protein, 906 aa, Homo sapiens
  Payload ID: 6917
  Gene Symbol: GRIN1
  Gene Name: glutamate receptor, ionotropic, N-methyl D-aspartate 1
  Uniprot ID: Q05586
  ENSP ID: ENSP00000360615
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQQYHPTDITGPLNLSDPSVSTVV

SEQ ID NO: 35049 - protein, 938 aa, Homo sapiens
  Payload ID: 6917
  Gene Symbol: GRIN1
  Gene Name: glutamate receptor, ionotropic, N-methyl D-aspartate 1
  Uniprot ID: Q05586
  ENSP ID: ENSP00000360616
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 35050 - protein, 1464 aa, Homo sapiens [sequence omitted]

SEQ ID NO: 35051 - protein, 1464 aa, Homo sapiens [sequence omitted]

SEQ ID NO: 35052 - protein, 1327 aa, Homo sapiens
  Payload ID: 6918
  Gene Symbol: GRIN2A
  Gene Name: glutamate receptor, ionotropic, N-methyl D-aspartate 2A
  ENSP ID: ENSP00000379820
QDPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGNPATGEQVYQQDWAQNNALQLQKNKLRISRQHSYDNIVDKPRELDLSRPSRSISLKDRERLLEGNFYGSLFSVPSSKLSGKKSSLFPQGLEDSKRSKSLLPDHTSDNPFLHSHRDDQRLVIGRCPSDPYKHSLPSQAVNDSYLRSSLRSTASYCSRDSRGHNDVYISEHVMPYAANKNNMYSTPRVLNSCSNRRVYKKMPSIESDV

SEQ ID NO: 35053 - protein, 1144 aa, Homo sapiens
  Payload ID: 6918
  Gene Symbol: GRIN2A
  Gene Name: glutamate receptor, ionotropic, N-methyl D-aspartate 2A
  ENSP ID: ENSP00000441572
QDPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGMTNAWLLGDAPRTLTNTRCHPRR

SEQ ID NO: 35054 - protein, 1281 aa, Homo sapiens
  Payload ID: 6918
  Gene Symbol: GRIN2A
  Gene Name: glutamate receptor, ionotropic, N-methyl D-aspartate 2A
  Uniprot ID: Q12879
  ENSP ID: ENSP00000454998
MGRVGYWTLLVLPALLVWRGPAPSAAAEKGPPALNIAVMLGHSHDVTERELRTLWGPEQAAGLPLDVNVVALLMNRTDPKSLITHVCDLMSGARIHGLVFGDDTDQEAVAQMLDFISSHTFVPILGIHGGASMIMADKDPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGMTNAWLLGDAPRTLTNTRCHPRR

SEQ ID NO: 35055 - protein, 1484 aa, Homo sapiens [sequence omitted]

SEQ ID NO: 35056 - protein, 35 aa, Homo sapiens
  Payload ID: 6919
  Gene Symbol: GRIN2B
  Gene Name: glutamate receptor, ionotropic, N-methyl D-aspartate 2B
  ENSP ID: ENSP00000486411
MKPRAECCSPKFWLVLAVLAVSGSRARSQKSPPSI

SEQ ID NO: 35057 - protein, 35 aa, Homo sapiens; identical to SEQ ID NO: 35056
  Payload ID: 6919
  Gene Symbol: GRIN2B
  Gene Name: glutamate receptor, ionotropic, N-methyl D-aspartate 2B
  ENSP ID: ENSP00000486677

SEQ ID NO: 35058 - protein, 1233 aa, Homo sapiens
  Payload ID: 6920
  Gene Symbol: GRIN2C
  Gene Name: glutamate receptor, ionotropic, N-methyl D-aspartate 2C
  Uniprot ID: Q14957
  ENSP ID: ENSP00000293190
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 35059 - protein, 873 aa, Homo sapiens
  Payload ID: 6920
  Gene Symbol: GRIN2C
  Gene Name: glutamate receptor, ionotropic, N-methyl D-aspartate 2C
  ENSP ID: ENSP00000338645
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRVGAHPSPHRPKF

SEQ ID NO: 35060 - protein, 1336 aa, Homo sapiens
  Payload ID: 6921
  Gene Symbol: GRIN2D
  Gene Name: glutamate receptor, ionotropic, N-methyl D-aspartate 2D
  Uniprot ID: O15399
  ENSP ID: ENSP00000263269
MRGAGGPRGPRGPAKMLLLLALACASPFPEEAPGPGGAGGPGGGLGGARPLNVALVFSGPAYAAEAARLGPAVAAAVRSPGLDVRPVALVLNGSDPRSLVLQLCDLLSGLRVHGVVFEDDSRAPAVAPILDFLSAQTSLPIVAVHGGAALVLTPKEKGSTFLQLGSSTEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLTVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGKLDAFIYDAAVLNYMARKDEGCKLVTIGSGKVFATTGYGIALHKGSRWKRPIDLALLQFLGDDEIEMLERLWLSGICHNDKIEVMSSKLDIDNMAGVFYMLLVAMGLSLLVFAWEHLVYWRLRHCLGPTHRMDFLLAFSRGMYSCCSAEAAPPPAKPPPPPQPLPSPAYPAPRPAPGPAPFVPRERASVDRWRRTKGAGPPGGAGLADGFHRYYGPIEPQGLGLGLGEARAAPRGAAGRPLSPPAAQPPQKPPPSYFAIVRDKEPAEPPAGAFPGFPSPPAPPAAAATAVGPPLCRLAFEDESPPAPARWPRSDPESQPLLGPGAGGAGGTGGAGGGAPAAPPPCRAAPPPCPYLDLEPSPSDSEDSESLGGASLGGLEPWWFADFPYPYAERLGPPPGRYWSVDKLGGWRAGSWDYLPPRSGPAAWHCRHCASLELLPPPRHLSCSHDGLDGGWWAPPPPPWAAGPLPRRRARCGCPRSHPHRPRASHRTPAAAAPHHHRHRRAAGGWDLPPPAPTSRSLEDLSSCPRAAPARRLTGPSRHARRCPHAAHWGPPLPTASHRRHRGGDLGTRRGSAHFSSLESEV

SEQ ID NO: 35061 - protein, 371 aa, Homo sapiens
  Payload ID: 6922
  Gene Symbol: GRINA
  Gene Name: glutamate receptor, ionotropic, N-methyl D-aspartate-associated protein 1 (glutamate binding)
  Uniprot ID: Q7Z429
  ENSP ID: ENSP00000314380
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 35062 - protein, 371 aa, Homo sapiens; identical to SEQ ID NO: 35061
  Payload ID: 6922
  Gene Symbol: GRINA
  Gene Name: glutamate receptor, ionotropic, N-methyl D-aspartate-associated protein 1 (glutamate binding)
  Uniprot ID: Q7Z429
  ENSP ID: ENSP00000378507

SEQ ID NO: 35063 - protein, 184 aa, Homo sapiens
  Payload ID: 6922
  Gene Symbol: GRINA
  Gene Name: glutamate receptor, ionotropic, N-methyl D-aspartate-associated protein 1 (glutamate binding)
  ENSP ID: ENSP00000431217
  MOD_RES (1)..(1): Any amino acid
XDFPATNWDDKSIRQAFIRKVFLVLTLQLSVTLSTVSVFTFVAESVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 35064 - protein, 188 aa, Homo sapiens
  Payload ID: 6922
  Gene Symbol: GRINA
  Gene Name: glutamate receptor, ionotropic, N-methyl D-aspartate-associated protein 1 (glutamate binding)
  ENSP ID: ENSP00000432095
  MOD_RES (1)..(1): Any amino acid
XNPYGQPQVFPGQDPDSPQHGNYQEEGPPSYYDNQDFPATNWDDKSIRQAFIRKSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTI

SEQ ID NO: 35065 - protein, 274 aa, Homo sapiens
  Payload ID: 6922
  Gene Symbol: GRINA
  Gene Name: glutamate receptor, ionotropic, N-methyl D-aspartate-associated protein 1 (glutamate binding)
  ENSP ID: ENSP00000432706
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQ

SEQ ID NO: 35066 - protein, 350 aa, Homo sapiens
  Payload ID: 6922
  Gene Symbol: GRINA
  Gene Name: glutamate receptor, ionotropic, N-methyl D-aspartate-associated protein 1 (glutamate binding)
  ENSP ID: ENSP00000435901
  MOD_RES (1)..(1): Any amino acid
XGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALVTPKPEPLCLGPAMQSHTPTLPGLVTVVLLVLMRQGPAGVAWGHTPKVSLCLPTAVGPDRQPVVHGGDDRQLLQHRGSHHGRGHHHSRLLHRRHLLHADPLRLHLMHGRAPGEHGGALHLRHSLHLHPEPHPGDRVRLTGRSALHLLPRSGHPAATGEQAAVPEPRRVCVCCAEPVHRHHQHLPVHPHHHWPRQG

SEQ ID NO: 35067 - protein, 101 aa, Homo sapiens
  Payload ID: 6922
  Gene Symbol: GRINA
  Gene Name: glutamate receptor, ionotropic, N-methyl D-aspartate-associated protein 1 (glutamate binding)
  ENSP ID: ENSP00000436807
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQ

SEQ ID NO: 35068 - protein, 1115 aa, Homo sapiens
  Payload ID: 6923
  Gene Symbol: GRIN3A
  Gene Name: glutamate receptor, ionotropic, N-methyl-D-aspartate 3A
  Uniprot ID: Q8TCU5
  ENSP ID: ENSP00000355155
MRRLSLWWLLSRVCLLLPPPCALVLAGVPSSSSHPQPCQILKRIGHAVRVGAVHLQPWTTAPRAASRAPDDSRAGAQRDEPEPGTRRSPAPSPGARWLGSTLHGRGPPGSRKPGEGARAEALWPRDALLFAVDNLNRVEGLLPYNLSLEVVMAIEAGLGDLPLLPFSSPSSPWSSDPFSFLQSVCHTVVVQGVSALLAFPQSQGEMMELDLVSLVLHIPVISIVRHEFPRESQNPLHLQLSLENSLSSDADVTVSILTMNNWYNFSLLLCQEDWNITDFLLLTQNNSKFHLGSIINITANLPSTQDLLSFLQIQLESIKNSTPTVVMFGCDMESIRRIFEITTQFGVMPPELRWVLGDSQNVEELRTEGLPLGLIAHGKTTQSVFEHYVQDAMELVARAVATATMIQPELALIPSTMNCMEVETTNLTSGQYLSRFLANTTFRGLSGSIRVKGSTIVSSENNFFIWNLQHDPMGKPMWTRLGSWQGGKIVMDYGIWPEQAQRHKTHFQHPSKLHLRVVTLIEHPFVFTREVDDEGLCPAGQLCLDPMTNDSSTLDSLFSSLHSSNDTVPIKFKKCCYGYCIDLLEKIAEDMNFDFDLYIVGDGKYGAWKNGHWTGLVGDLLRGTAHMAVTSFSINTARSQVIDFTSPFFSTSLGILVRTRDTAAPIGAFMWPLHWTMWLGIFVALHITAVFLTLYEWKSPFGLTPKGRNRSKVFSFSSALNICYALLFGRTVAIKPPKCWTGRFLMNLWAIFCMFCLSTYTANLAAVMVGEKIYEELSGIHDPKLHHPSQGFRFGTVRESSAEDYVRQSFPEMHEYMRRYNVPATPDGVEYLKNDPEKLDAFIMDKALLDYEVSIDADCKLLTVGKPFAIEGYGIGLPPNSPLTANISELISQYKSHGFMDMLHDKWYRVVPCGKRSFAVTETLQMGIKHFSGLFVLLCIGFGLSILTTIGEHIVYRLLLPRIKNKSKLQYWLHTSQRLHRAINTSFIEEKQQHFKTKRVEKRSNVGPRQLTVWNTSNLSHDNRRKYIFSDEEGQNQLGIRIHQDIPLPPRRRELPALRTTNGKADSLNVSRNSVMQELSELEKQIQVIRQELQLAVSRKTELEEYQRTSRTCES

SEQ ID NO: 35069 - protein, 1043 aa, Homo sapiens
  Payload ID: 6924
  Gene Symbol: GRIN3B
  Gene Name: glutamate receptor, ionotropic, N-methyl-D-aspartate 3B
  Uniprot ID: O60391
  ENSP ID: ENSP00000234389
MEFVRALWLGLALALGPGSAGGHPQPCGVLARLGGSVRLGALLPRAPLARARARAALARAALAPRLPHNLSLELVVAAPPARDPASLTRGLCQALVPPGVAALLAFPEARPELLQLHFLAAATETPVLSLLRREARAPLGAPNPFHLQLHWASPLETLLDVLVAVLQAHAWEDVGLALCRTQDPGGLVALWTSRAGRPPQLVLDLSRRDTGDAGLRARLAPMAAPVGGEAPVPAAVLLGCDIARARRVLEAVPPGPHWLLGTPLPPKALPTAGLPPGLLALGEVARPPLEAAIHDIVQLVARALGSAAQVQPKRALLPAPVNCGDLQPAGPESPGRFLARFLANTSFQGRTGPVWVTGSSQVHMSRHFKVWSLRRDPRGAPAWATVGSWRDGQLDLEPGGASARPPPPQGAQVWPKLRVVTLLEHPFVFARDPDEDGQCPAGQLCLDPGTNDSATLDALFAALANGSAPRALRKCCYGYCIDLLERLAEDTPFDFELYLVGDGKYGALRDGRWTGLVGDLLAGRAHMAVTSFSINSARSQVVDFTSPFFSTSLGIMVRARDTASPIGAFMWPLHWSTWLGVFAALHLTALFLTVYEWRSPYGLTPRGRNRSTVFSYSSALNLCYAILFRRTVSSKTPKCPTGRLLMNLWAIFCLLVLSSYTANLAAVMVGDKTFEELSGIHDPKLHHPAQGFRFGTVWESSAEAYIKKSFPDMHAHMRRHSAPTTPRGVAMLTSDPPKLNAFIMDKSLLDYEVSIDADCKLLTVGKPFAIEGYGIGLPQNSPLTSNLSEFISRYKSSGFIDLLHDKWYKMVPCGKRVFAVTETLQMSIYHFAGLFVLLCLGLGSALLSSLGEHAFFRLALPRIRKGSRLQYWLHTSQKIHRALNTEPPEGSKEETAEAEPSGPEVEQQQQQQDQPTAPEGWKRARRAVDKERRVRFLLEPAVVVAPEADAEAEAAPREGPVWLCSYGRPPAARPTGAPQPGELQELERRIEVARERLRQALVRRGQLLAQLGDSARHRPRRLLQARAAPAEAPPHSGRPGSQE

SEQ ID NO: 35070 - protein, 1194 aa, Homo sapiens
  Payload ID: 6925
  Gene Symbol: GRM1
  Gene Name: glutamate receptor, metabotropic 1
  Uniprot ID: Q13255
  ENSP ID: ENSP00000282753
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNANSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPSHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 35071 - protein, 908 aa, Homo sapiens
  Payload ID: 6925
  Gene Symbol: GRM1
  Gene Name: glutamate receptor, metabotropic 1
  Uniprot ID: Q13255
  ENSP ID: ENSP00000347437
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNAKWRTGAQGTAYVAPPLCAREDQ

SEQ ID NO: 35072 - protein, 1194 aa, Homo sapiens; identical to SEQ ID NO: 35070
  Payload ID: 6925
  Gene Symbol: GRM1
  Gene Name: glutamate receptor, metabotropic 1
  Uniprot ID: Q13255
  ENSP ID: ENSP00000354896

SEQ ID NO: 35073 - protein, 906 aa, Homo sapiens
  Payload ID: 6925
  Gene Symbol: GRM1
  Gene Name: glutamate receptor, metabotropic 1
  Uniprot ID: Q13255
  ENSP ID: ENSP00000424095
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNAKKRQPEFSPTSQCPSAHVQL

SEQ ID NO: 35074 - protein, 906 aa, Homo sapiens; identical to SEQ ID NO: 35073
  Payload ID: 6925
  Gene Symbol: GRM1
  Gene Name: glutamate receptor, metabotropic 1
  Uniprot ID: Q13255
  ENSP ID: ENSP00000425599

SEQ ID NO: 35075 - protein, 435 aa, Homo sapiens
  Payload ID: 6926
  Gene Symbol: GRM2
  Gene Name: glutamate receptor, metabotropic 2
  ENSP ID: ENSP00000296479
MGSLLALLALLLLWGAVAEGPAKKVLTLEGDLVLGGLFPVHQKGGPAEDCGPVNEHRGIQRLEAMLFALDRINRDPHLLPGVRLGAHILDSCSKDTHALEQALDFVRASLSRGADGSRHICPDGSYATHGDAPTAITGVIGGSYSDVSIQVANLLRLFQIPQISYASTSAKLSDKSRYDYFARTVPPDFFQAKAMAEILRFFNWTYVSTVASEGDYGETGIEAFELEARARNICVATSEKVGRAMSRAAFEGVVRALLQKPSARVAVLFTRSEDARELLAASQRLNASFTWVASDGWGALESVVAGSEGAAEGAITIELASYPISDFASYFQSLDPWNNSRNPWFREFWEQRFRCSFRQRDCAAHSLRAVPFEQESKIMFVVNAVYAMAHALHNMHRALCPNTTRLCDAMRPVNGRRLYKDFVLNVKFDGDLKVS

SEQ ID NO: 35076 - protein, 872 aa, Homo sapiens [sequence omitted]

SEQ ID NO: 35077 - protein, 70 aa, Homo sapiens [sequence omitted]

SEQ ID NO: 35078 - protein, 594 aa, Homo sapiens
  Payload ID: 6926
  Gene Symbol: GRM2
  Gene Name: glutamate receptor, metabotropic 2
  ENSP ID: ENSP00000408906
MGSLLALLALLLLWGAVAEGPAKKVLTLEGDLVLGGLFPVHQKGGPAEDCGPVNEHRGIQRLEAMLFALDRINRDPHLLPGVRLGAHILDSCSKDTHALEQALDFVRASLSRGADGSRHICPDGSYATHGDAPTAITGVIGGSYSDVSIQVANLLRLFQIPQISYASTSAKLSDKSRYDYFARTVPPDFFQAKAMAEILRFFNWTYVSTVASEGDYGETGIEAFELEARARNICVATSEKVGRAMSRAAFEGVVRALLQKPSARVAVLFTRSEDARELLAASQRLNASFTWVASDGWGALESVVAGSEGAAEGAITIELASYPISDFASYFQSLDPWNNSRNPWFREFWEQRFRCSFRQRDCAAHSLRAVPFEQESKIMFVVNAVYAMAHALHNMHRALCPNTTRLCDAMRPVNGRRLYKDFVLNVKFDAPFRPADTHNEVRFDRFGDGIGRYNIFTYLRAGSGRYRYQKTRKCPENFNEAKFIGFTMYTTCIIWLAFLPIFYVTSSDYRVQTTTMCVSVSLSGSVVLGCLFAPKLHIILFQPQKNVVSHRAPTSRFGSAAARASSSLGQGSGSQFVPTVCNGREVVDSTTSSL

SEQ ID NO: 35079 - protein, 879 aa, Homo sapiens
  Payload ID: 6927
  Gene Symbol: GRM3
  Gene Name: glutamate receptor, metabotropic 3
  Uniprot ID: Q14832
  ENSP ID: ENSP00000355316
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 35080 - protein, 87 aa, Homo sapiens
  Payload ID: 6927
  Gene Symbol: GRM3
  Gene Name: glutamate receptor, metabotropic 3
  ENSP ID: ENSP00000390037
MKMLTRLQVLTLALFSKGFLLSLGDHNFLRREIKIEGDLVLGGLFPINEKGTGTEECGRINEDRGIQRLEAMLFAIDEINKDDYLLP

SEQ ID NO: 35081 - protein, 537 aa, Homo sapiens
  Payload ID: 6927
  Gene Symbol: GRM3
  Gene Name: glutamate receptor, metabotropic 3
  Uniprot ID: Q14832
  ENSP ID: ENSP00000398767
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTGADDNHVHLCQPEWLCGLGLFVCTQGSHHPVSTPEECCHTQTAPQQVQCQWNWDHILSVLCKHVCANGVQWAGSPRLHHLISVIVNCSSVLVFLDC

SEQ ID NO: 35082 - protein, 171 aa, Homo sapiens
  Payload ID: 6927
  Gene Symbol: GRM3
  Gene Name: glutamate receptor, metabotropic 3
  ENSP ID: ENSP00000405427
MSQSPGAGSPPPLPPRSAPVPARSCRCEVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVA

SEQ ID NO: 35083 - protein, 81 aa, Homo sapiens
  Payload ID: 6927
  Gene Symbol: GRM3
  Gene Name: glutamate receptor, metabotropic 3
  ENSP ID: ENSP00000407490
MKMLTRLQVLTLALFSKGFLLSLGDHNFLRREIKIEGDLVLGGLFPINEKGTGTEECGRINEDRGIQRLEAMLFAIDEINK

SEQ ID NO: 35084 - protein, 796 aa, Homo sapiens
  Payload ID: 6928
  Gene Symbol: GRM4
  Gene Name: glutamate receptor, metabotropic 4
  Uniprot ID: Q14833
  ENSP ID: ENSP00000363292
MPAWEPGVAASCGWRAPPCSPLRLCIAPHPCTPPSSHQGNLTCRLPPRSFGFCRCVWVRTRGPSLPGEQVSLAAHESEGAAAQLGSSPEIDPRRPRCLLPESAQIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRDRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 35085 - protein, 865 aa, Homo sapiens
  Payload ID: 6928
  Gene Symbol: GRM4
  Gene Name: glutamate receptor, metabotropic 4
  ENSP ID: ENSP00000363296
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRDRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 35086 - protein, 772 aa, Homo sapiens
  Payload ID: 6928
  Gene Symbol: GRM4
  Gene Name: glutamate receptor, metabotropic 4
  Uniprot ID: Q14833
  ENSP ID: ENSP00000398456
MVQTLPKLFPHDGAKRKKRTLRTSGPCFGGGGQIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 35087 - protein, 743 aa, Homo sapiens
  Payload ID: 6928
  Gene Symbol: GRM4
  Gene Name: glutamate receptor, metabotropic 4
  Uniprot ID: Q14833
  ENSP ID: ENSP00000437730
MSCKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 35088 - protein, 779 aa, Homo sapiens
  Payload ID: 6928
  Gene Symbol: GRM4
  Gene Name: glutamate receptor, metabotropic 4
  Uniprot ID: Q14833
  ENSP ID: ENSP00000437925
MAVPLGAPCWASALPAWAPPGLPHRSLLTRLLSQHVKPAKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 35089 - protein, 912 aa, Homo sapiens
  Payload ID: 6928
  Gene Symbol: GRM4
  Gene Name: glutamate receptor, metabotropic 4
  Uniprot ID: Q14833
  ENSP ID: ENSP00000440556
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 35090 - protein, 96 aa, Homo sapiens
  Payload ID: 6928
  Gene Symbol: GRM4
  Gene Name: glutamate receptor, metabotropic 4
  ENSP ID: ENSP00000476561
MGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEG

SEQ ID NO: 35091 - protein, 181 aa, Homo sapiens
  Payload ID: 6928
  Gene Symbol: GRM4
  Gene Name: glutamate receptor, metabotropic 4
  ENSP ID: ENSP00000477016
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKGACASPSR

SEQ ID NO: 35092 - protein, 779 aa, Homo sapiens; identical to SEQ ID NO: 35088
  Payload ID: 6928
  Gene Symbol: GRM4
  Gene Name: glutamate receptor, metabotropic 4
  Uniprot ID: Q14833
  ENSP ID: ENSP00000477466

SEQ ID NO: 35093 - protein, 1180 aa, Homo sapiens
  Payload ID: 6929
  Gene Symbol: GRM5
  Gene Name: glutamate receptor, metabotropic 5
  Uniprot ID: P41594
  ENSP ID: ENSP00000305905
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 35094 - protein, 1212 aa, Homo sapiens
  Payload ID: 6929
  Gene Symbol: GRM5
  Gene Name: glutamate receptor, metabotropic 5
  Uniprot ID: P41594
  ENSP ID: ENSP00000306138
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 35095 - protein, 298 aa, Homo sapiens
  Payload ID: 6929
  Gene Symbol: GRM5
  Gene Name: glutamate receptor, metabotropic 5
  ENSP ID: ENSP00000376972
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGRGTKKEEMRKRDQTLMLSFMRCVFLRFEEIRWNDSLVYDALENENIQVLSLCFPSSAVIQINTFLSPIALINRLNVT

SEQ ID NO: 35096 - protein, 87 aa, Homo sapiens
  Payload ID: 6929
  Gene Symbol: GRM5
  Gene Name: glutamate receptor, metabotropic 5
  ENSP ID: ENSP00000403724
  MOD_RES (1)..(1): Any amino acid
XQIAYSATSMDLSDKTLFKYFMRVVPSDAQQARAMVDIVKRYNWTYVSAVHTEGRGTKKEEMRKRDQTLMLSFMRFKLFSCLSLQRS

SEQ ID NO: 35097 - protein, 1180 aa, Homo sapiens; identical to SEQ ID NO: 35093
  Payload ID: 6929
  Gene Symbol: GRM5
  Gene Name: glutamate receptor, metabotropic 5
  Uniprot ID: P41594
  ENSP ID: ENSP00000405690

SEQ ID NO: 35098 - protein, 877 aa, Homo sapiens
  Payload ID: 6930
  Gene Symbol: GRM6
  Gene Name: glutamate receptor, metabotropic 6
  Uniprot ID: O15303
  ENSP ID: ENSP00000231188
MARPRRAREPLLVALLPLAWLAQAGLARAAGSVRLAGGLTLGGLFPVHARGAAGRACGQLKKEQGVHRLEAMLYALDRVNADPELLPGVRLGARLLDTCSRDTYALEQALSFVQALIRGRGDGDEVGVRCPGGVPPLRPAPPERVVAVVGASASSVSIMVANVLRLFAIPQISYASTAPELSDSTRYDFFSRVVPPDSYQAQAMVDIVRALGWNYVSTLASEGNYGESGVEAFVQISREAGGVCIAQSIKIPREPKPGEFSKVIRRLMETPNARGIIIFANEDDIRRVLEAARQANLTGHFLWVGSDSWGAKTSPILSLEDVAVGAITILPKRASIDGFDQYFMTRSLENNRRNIWFAEFWEENFNCKLTSSGTQSDDSTRKCTGEERIGRDSTYEQEGKVQFVIDAVYAIAHALHSMHQALCPGHTGLCPAMEPTDGRMLLQYIRAVRFNGSAGTPVMFNENGDAPGRYDIFQYQATNGSASSGGYQAVGQWAETLRLDVEALQWSGDPHEVPSSLCSLPCGPGERKKMVKGVPCCWHCEACDGYRFQVDEFTCEACPGDMRPTPNHTGCRPTPVVRLSWSSPWAAPPLLLAVLGIVATTTVVATFVRYNNTPIVRASGRELSYVLLTGIFLIYAITFLMVAEPGAAVCAARRLFLGLGTTLSYSALLTKTNRIYRIFEQGKRSVTPPPFISPTSQLVITFSLTSLQVVGMIAWLGARPPHSVIDYEEQRTVDPEQARGVLKCDMSDLSLIGCLGYSLLLMVTCTVYAIKARGVPETFNEAKPIGFTMYTTCIIWLAFVPIFFGTAQSAEKIYIQTTTLTVSLSLSASVSLGMLYVPKTYVILFHPEQNVQKRKRSLKATSTVAAPPKGEDAEAHK

SEQ ID NO: 35099 - protein, 877 aa, Homo sapiens; identical to SEQ ID NO: 35098
  Payload ID: 6930
  Gene Symbol: GRM6
  Gene Name: glutamate receptor, metabotropic 6
  Uniprot ID: O15303
  ENSP ID: ENSP00000430767

SEQ ID NO: 35100 - protein, 915 aa, Homo sapiens
  Payload ID: 6931
  Gene Symbol: GRM7
  Gene Name: glutamate receptor, metabotropic 7
  Uniprot ID: Q14831
  ENSP ID: ENSP00000350348
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 35101 - protein, 911 aa, Homo sapiens
  Payload ID: 6931
  Gene Symbol: GRM7
  Gene Name: glutamate receptor, metabotropic 7
  Uniprot ID: Q14831
  ENSP ID: ENSP00000373986
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNITSEDLSLHKED

SEQ ID NO: 35102 - protein, 906 aa, Homo sapiens
  Payload ID: 6931
  Gene Symbol: GRM7
  Gene Name: glutamate receptor, metabotropic 7
  Uniprot ID: Q14831
  ENSP ID: ENSP00000373987
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSEKCNCY

SEQ ID NO: 35103 - protein, 677 aa, Homo sapiens
  Payload ID: 6931
  Gene Symbol: GRM7
  Gene Name: glutamate receptor, metabotropic 7
  ENSP ID: ENSP00000384585
GGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNCIPPVRKSVQKSVTWYTIPPTV

SEQ ID NO: 35104 - protein, 122 aa, Homo sapiens
  Payload ID: 6931
  Gene Symbol: GRM7
  Gene Name: glutamate receptor, metabotropic 7
  ENSP ID: ENSP00000393799
MVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIA

SEQ ID NO: 35105 - protein, 185 aa, Homo sapiens
  Payload ID: 6931
  Gene Symbol: GRM7
  Gene Name: glutamate receptor, metabotropic 7
  ENSP ID: ENSP00000395035
MGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCK

SEQ ID NO: 35106 - protein, 68 aa, Homo sapiens
  Payload ID: 6931
  Gene Symbol: GRM7
  Gene Name: glutamate receptor, metabotropic 7
  ENSP ID: ENSP00000404161
MNPVPQMEMQKSPVFGHLGSSPEVLWNTRYYTEAAIWKDHLERFFIKTEPQSIRKHPCLISMKVMRRT

SEQ ID NO: 35107 - protein, 37 aa, Homo sapiens
  Payload ID: 6931
  Gene Symbol: GRM7
  Gene Name: glutamate receptor, metabotropic 7
  ENSP ID: ENSP00000405194
MAPELHWGDALLSCLSFPILNVLQKSPRLVMHQRHPS

SEQ ID NO: 35108 - protein, 913 aa, Homo sapiens
  Payload ID: 6931
  Gene Symbol: GRM7
  Gene Name: glutamate receptor, metabotropic 7
  ENSP ID: ENSP00000412329
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNFFFWLYSGTWITL

SEQ ID NO: 35109 - protein, 922 aa, Homo sapiens
  Payload ID: 6931
  Gene Symbol: GRM7
  Gene Name: glutamate receptor, metabotropic 7
  Uniprot ID: Q14831
  ENSP ID: ENSP00000417536
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNCIPPVRKSVQKSVTWYTIPPTV

SEQ ID NO: 35110 - protein, 922 aa, Homo sapiens; identical to SEQ ID NO: 35109
  Payload ID: 6931
  Gene Symbol: GRM7
  Gene Name: glutamate receptor, metabotropic 7
  Uniprot ID: Q14831
  ENSP ID: ENSP00000419835

SEQ ID NO: 35111 - protein, 908 aa, Homo sapiens
  Payload ID: 6932
  Gene Symbol: GRM8
  Gene Name: glutamate receptor, metabotropic 8
  Uniprot ID: O00222
  ENSP ID: ENSP00000344173
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 35112 - protein, 501 aa, Homo sapiens
  Payload ID: 6932
  Gene Symbol: GRM8
  Gene Name: glutamate receptor, metabotropic 8
  Uniprot ID: O00222
  ENSP ID: ENSP00000345747
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGCRRGIQMSLPWPTLFTPSFSSSWAVLALLSLLMKTEMLLDVMISSSIK

SEQ ID NO: 35113 - protein, 908 aa, Homo sapiens
  Payload ID: 6932
  Gene Symbol: GRM8
  Gene Name: glutamate receptor, metabotropic 8
  Uniprot ID: O00222
  ENSP ID: ENSP00000351142
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNSKSSVEFPMVKSGSTS

SEQ ID NO: 35114 - protein, 20 aa, Homo sapiens
  Payload ID: 6932
  Gene Symbol: GRM8
  Gene Name: glutamate receptor, metabotropic 8
  ENSP ID: ENSP00000398012
MVCEGKRSASCPCFFLLTAK

SEQ ID NO: 35115 - protein, 416 aa, Homo sapiens
  Payload ID: 6932
  Gene Symbol: GRM8
  Gene Name: glutamate receptor, metabotropic 8
  ENSP ID: ENSP00000409790
NFLYPQVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 35116 - protein, 293 aa, Homo sapiens
  Payload ID: 6932
  Gene Symbol: GRM8
  Gene Name: glutamate receptor, metabotropic 8
  ENSP ID: ENSP00000415522
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEA

SEQ ID NO: 35117 - protein, 91 aa, Homo sapiens
  Payload ID: 6932
  Gene Symbol: GRM8
  Gene Name: glutamate receptor, metabotropic 8
  ENSP ID: ENSP00000418255
FFSRVVPPDSYQAQAMVDIVTALGWNYVSTLASEGNYGESGVEAFTQISREIGYPSLFGIQGCLHECFAILCQVVYQFLLLMQLSDAQTVY

SEQ ID NO: 35118 - protein, 908 aa, Homo sapiens; identical to SEQ ID NO: 35113
  Payload ID: 6932
  Gene Symbol: GRM8
  Gene Name: glutamate receptor, metabotropic 8
  Uniprot ID: O00222
  ENSP ID: ENSP00000419832

SEQ ID NO: 35119 - protein, 373 aa, Homo sapiens
  Payload ID: 6933
  Gene Symbol: GLUL
  Gene Name: glutamate-ammonia ligase
  Uniprot ID: P15104
  ENSP ID: ENSP00000307900
MTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQGPYYCGVGADRAYGRDIVEAHYRACLYAGVKIAGTNAEVMPAQWEFQIGPCEGISMGDHLWVARFILHRVCEDFGVIATFDPKPIPGNWNGAGCHTNFSTKAMREENGLKYIEEAIEKLSKRHQYHIRAYDPKGGLDNARRLTGFHETSNINDFSAGVANRSASIRIPRTVGQEKKGYFEDRRPSANCDPFSVTEALIRTCLLNETGDEPFQYKN

SEQ ID NO: 35120 - protein, 373 aa, Homo sapiens; identical to SEQ ID NO: 35119
  Payload ID: 6933
  Gene Symbol: GLUL
  Gene Name: glutamate-ammonia ligase
  Uniprot ID: P15104
  ENSP ID: ENSP00000344958

SEQ ID NO: 35121 - protein, 373 aa, Homo sapiens; identical to SEQ ID NO: 35119
  Payload ID: 6933
  Gene Symbol: GLUL
  Gene Name: glutamate-ammonia ligase
  Uniprot ID: P15104
  ENSP ID: ENSP00000356537

SEQ ID NO: 35122 - protein, 373 aa, Homo sapiens; identical to SEQ ID NO: 35119
  Payload ID: 6933
  Gene Symbol: GLUL
  Gene Name: glutamate-ammonia ligase
  Uniprot ID: P15104
  ENSP ID: ENSP00000398320

SEQ ID NO: 35123 - protein, 233 aa, Homo sapiens
  Payload ID: 6933
  Gene Symbol: GLUL
  Gene Name: glutamate-ammonia ligase
  ENSP ID: ENSP00000481855
MTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFQGPRVHITVVWEQTEPMAGTSWRPITGPACMLESRLRGLMPRSCLPSGNFRLDLVKESAWEIISGWPVSSCIVCVKTLE

SEQ ID NO: 35124 - protein, 637 aa, Homo sapiens
  Payload ID: 6934
  Gene Symbol: GCLC
  Gene Name: glutamate-cysteine ligase, catalytic subunit
  Uniprot ID: P48506
  ENSP ID: ENSP00000229416
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 35125 - protein, 54 aa, Homo sapiens
  Payload ID: 6934
  Gene Symbol: GCLC
  Gene Name: glutamate-cysteine ligase, catalytic subunit
  ENSP ID: ENSP00000421228
MGLLSQGSPLSWEETKRHADHVRRHGILQFLHIYHAVKDRHKDVLKWGDEVTNL

SEQ ID NO: 35126 - protein, 122 aa, Homo sapiens
  Payload ID: 6934
  Gene Symbol: GCLC
  Gene Name: glutamate-cysteine ligase, catalytic subunit
  ENSP ID: ENSP00000421629
MLVSFDHENKKVRLVLSGEKVLETLQEKGERTNPNHPTLWRPEYGSYMIEGTPGQPYGGTMSEFNTVEANMRKRRKEATSILEENQALCTITSFPRLSWVHTARGQTQPSGRRSFQVPLLSR

SEQ ID NO: 35127 - protein, 252 aa, Homo sapiens
  Payload ID: 6934
  Gene Symbol: GCLC
  Gene Name: glutamate-cysteine ligase, catalytic subunit
  ENSP ID: ENSP00000421908
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQV

SEQ ID NO: 35128 - protein, 154 aa, Homo sapiens
  Payload ID: 6934
  Gene Symbol: GCLC
  Gene Name: glutamate-cysteine ligase, catalytic subunit
  ENSP ID: ENSP00000423615
MLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPI

SEQ ID NO: 35129 - protein, 173 aa, Homo sapiens
  Payload ID: 6934
  Gene Symbol: GCLC
  Gene Name: glutamate-cysteine ligase, catalytic subunit
  ENSP ID: ENSP00000424211
  MOD_RES (1)..(1): Any amino acid
XETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPSTLTRNIRHRRGEKVVINVPIFKDKNTPSPFIETFTE

SEQ ID NO: 35130 - protein, 93 aa, Homo sapiens
  Payload ID: 6934
  Gene Symbol: GCLC
  Gene Name: glutamate-cysteine ligase, catalytic subunit
  ENSP ID: ENSP00000426578
NIQSTNWQTMRFKPPPPNSDIGWRVEFRPMEVQLTDFENSAYVVFVVLLTRVILSYKLDFLIPLSKVRICFFMVMGIDLSVDIFIYICYLFPT

SEQ ID NO: 35131 - protein, 18 aa, Homo sapiens
  Payload ID: 6934
  Gene Symbol: GCLC
  Gene Name: glutamate-cysteine ligase, catalytic subunit
  ENSP ID: ENSP00000427403
MLVSFDHENKKVRLVLSG

SEQ ID NO: 35132 - protein, 599 aa, Homo sapiens
  Payload ID: 6934
  Gene Symbol: GCLC
  Gene Name: glutamate-cysteine ligase, catalytic subunit
  ENSP ID: ENSP00000482756
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 35133 - protein, 274 aa, Homo sapiens
  Payload ID: 6935
  Gene Symbol: GCLM
  Gene Name: glutamate-cysteine ligase, modifier subunit
  Uniprot ID: P48507
  ENSP ID: ENSP00000359258
MGTDSRAAKALLARARTLHLQTGNLLNWGRLRKKCPSTHSEELHDCIQKTLNEWSSQINPDLVREFPDVLECTVSHAVEKINPDEREEMKVSAKLFIVESNSSSSTRSAVDMACSVLGVAQLDSVIIASPPIEDGVNLSLEHLQPYWEELENLVQSKKIVAIGTSDLDKTQLEQLYQWAQVKPNSNQVNLASCCVMPPDLTAFAKQFDIQLLTHNDPKELLSEASFQEALQESIPDIQAHEWVPLWLLRYSVIVKSRGIIKSKGYILQAKRRGS

SEQ ID NO: 35134 - protein, 252 aa, Homo sapiens
  Payload ID: 6935
  Gene Symbol: GCLM
  Gene Name: glutamate-cysteine ligase, modifier subunit
  Uniprot ID: P48507
  ENSP ID: ENSP00000484507
MGTDSRAAKALLARARTLHLQTGNLLNWGRLRKKCPSTHSEEEFPDVLECTVSHAVEKINPDEREEMKVSAKLFIVESNSSSSTRSAVDMACSVLGVAQLDSVIIASPPIEDGVNLSLEHLQPYWEELENLVQSKKIVAIGTSDLDKTQLEQLYQWAQVKPNSNQVNLASCCVMPPDLTAFAKQFDIQLLTHNDPKELLSEASFQEALQESIPDIQAHEWVPLWLLRYSVIVKSRGIIKSKGYILQAKRRGS

SEQ ID NO: 35135 - protein, 443 aa, Homo sapiens
  Payload ID: 6936
  Gene Symbol: ERICH1
  Gene Name: glutamate-rich 1
  Uniprot ID: Q86X53
  ENSP ID: ENSP00000262109
MAAHRKHVFVEKVLQRLFPPVPSGQGKREPQTLAVQNPPKKVTSEKVSQKHAEPLTDTGSETPTARRLYTASGPPEGYVPCWPEPSSCGSPENASSGDDTEDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPDHARVISAFFSYWITHILPEKSSD
